United States Patent
Li et al.

(10) Patent No.: US 9,382,517 B2
(45) Date of Patent: Jul. 5, 2016

(54) HCV FULL-LENGTH INFECTIOUS CELL CULTURE SYSTEMS AND APPLICATIONS THEREOF

(71) Applicants: Hvidovre Hospital, Hvidovre (DK); Københavns Universitet, København K (DK)

(72) Inventors: Yiping Li, Hvidovre (DK); Troels Kasper Høyer Scheel, New York, NY (US); Santseharay Ramirez Almeida, Hvidovre (DK); Judith M. Gottwein, Frederiksberg (DK); Jens Bukh, Pæstø (DK)

(73) Assignees: Hvidovre Hospital, Hvidovre (DK); Københavns Universitet, København K (DK)

( * ) Notice: Subject to any disclaimer, the term of this patent is extended or adjusted under 35 U.S.C. 154(b) by 52 days.

(21) Appl. No.: 14/386,219

(22) PCT Filed: Mar. 15, 2013

(86) PCT No.: PCT/DK2013/050070
§ 371 (c)(1),
(2) Date: Sep. 18, 2014

(87) PCT Pub. No.: WO2013/139339
PCT Pub. Date: Sep. 26, 2013

(65) Prior Publication Data
US 2015/0152392 A1 Jun. 4, 2015

Related U.S. Application Data

(60) Provisional application No. 61/613,138, filed on Mar. 20, 2012, provisional application No. 61/722,675, filed on Nov. 5, 2012.

(51) Int. Cl.
*C12N 7/00* (2006.01)
*C12Q 1/70* (2006.01)

(52) U.S. Cl.
CPC ........ *C12N 7/00* (2013.01); *C12Q 1/707* (2013.01); *C12N 2770/24221* (2013.01); *C12N 2770/24234* (2013.01); *C12N 2770/24252* (2013.01); *C12N 2770/24271* (2013.01); *C12Q 2600/156* (2013.01); *C12Q 2600/158* (2013.01)

(58) Field of Classification Search
None
See application file for complete search history.

(56) References Cited

U.S. PATENT DOCUMENTS

2009/0252755 A1   10/2009   Bukh et al.

OTHER PUBLICATIONS

GenBank: BAD73984.1. polyprotein, partial [Hepatitis C virus subtype 1 b]. Dated Oct. 17, 2008.*
GenBank: AF009606.1. Hepatitis C virus subtype 1a polyprotein gene, complete cds. Dated Jun. 18, 2009.*
Bukh, Jens et al., "A milestone for hepatitis C virus research: A virus generated in cell culture is fully viable in vivo" PNAS, Mar. 7, 2006, pp. 3500-3501, vol. 103, No. 10.
Yi-Ping, Li et al., "Robust full-length hepatitis C virus genotype 2a and 2b infectious cultures using mutations identified by a systematic approach applicable to patient strains" PNAS, May, 2012, vol. 109, No. 18.
Yi-Ping, Li et al., "Highly efficient full-length hepatitis C virus genotype 1 (strain TN) infectious culture system" PNAS, Nov. 27, 2012, pp. 19757-19762, vol. 109, No. 48.
Database UniParc—Database accession No. UPI00029CEA20, XP002699169, Nov. 28, 2012.

* cited by examiner

*Primary Examiner* — Nick Zou
(74) *Attorney, Agent, or Firm* — Knobbe Martens Olson & Bear LLP

(57) ABSTRACT

The present invention relates to nucleic acid sequences that encode hepatitis C viruses (HCV) that are useful in the fundamental research of HCV as well as in the search of a vaccine against HCV. In particular the present invention relates to nucleic acid sequences that comprises HCVs which are capable of expressing said virus when transfected into cells and are capable of infectivity in vivo.

20 Claims, 25 Drawing Sheets

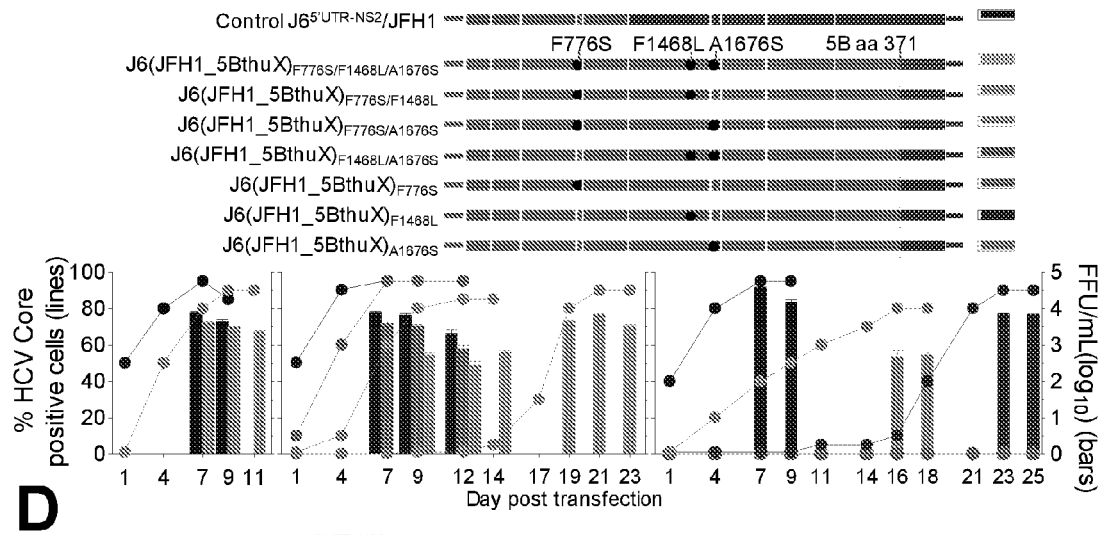
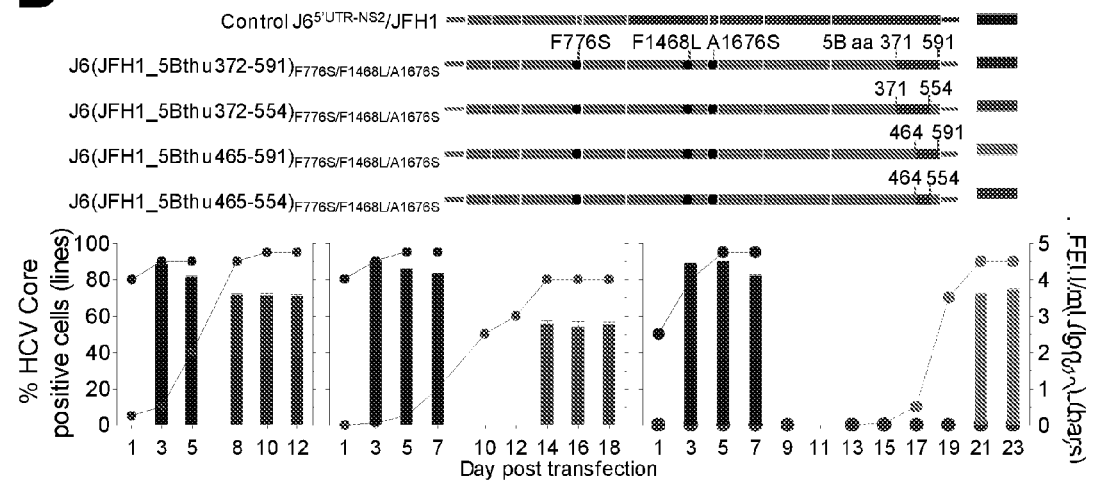
Fig. 1
(continued)

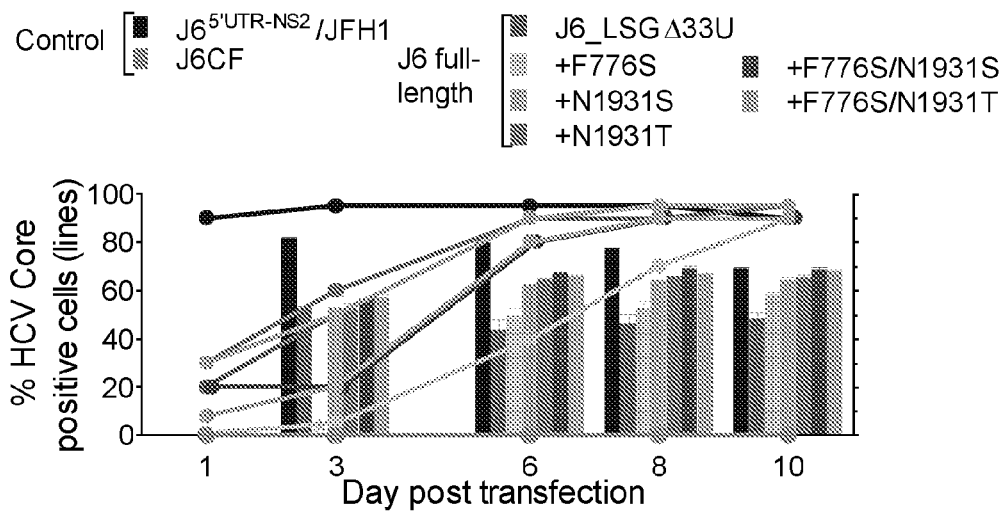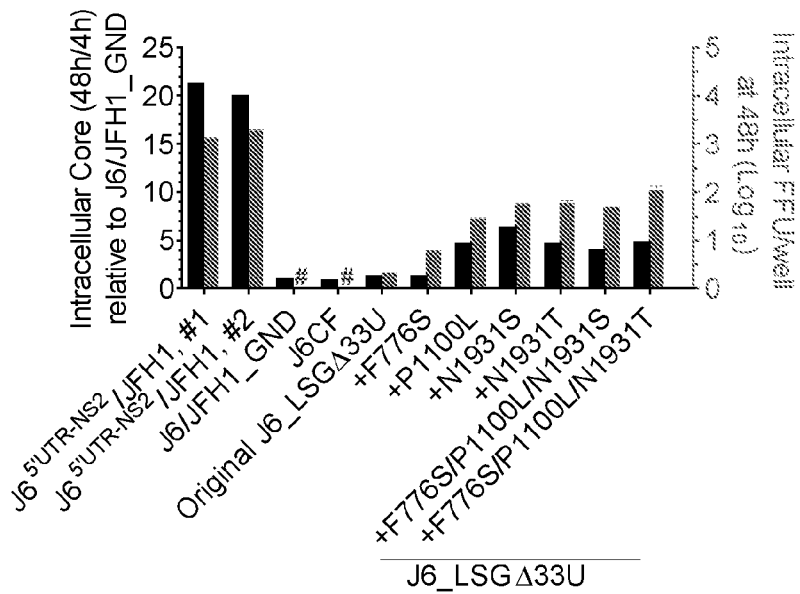
Fig. 2 (continued)

Fig. 4 (Table 1)

| HCV gene | p7 | NS2 | NS2 | NS3 | NS3 | NS4A | NS4A | NS4A | NS4B | NS5A | NS5B | NS5B |
|---|---|---|---|---|---|---|---|---|---|---|---|---|
| Nucleotide position | | | | | | | | | | | | |
| Recombinant specific | 2667 | 2835 | 2981 | 4727 | 4742 | 5331 | 5332 | 5366 | 6132 | 7655 | 8548 | 9271 |
| H77 ref (AF009606) | 2656 | 2824 | 2970 | 4716 | 4731 | 5320 | 5321 | 5355 | 6121 | 7590 | 8483 | 9206 |
| Recombinant nucleotide | T | T | G | A | T | G | G | G | A | G | A | A |
| J6 recombinant | Exp. (day) | | | | | | | | | | | |
| J6(JFH1_5BX), exp. 1* | 1st pas. (14) | T/C | | A/G | | G/C | G/T | | A/G | | | A/G |
| J6(JFH1_5BX), exp. 2* | 1st pas. (8) | T/C | | | | G/c | G/t | | | | | |
| J6(JFH1_5BpalX) | Transf. (31) | | A/g | | | | G/T | G/T | | T/g | | |
| J6(JFH1_5BthuX)* | 1st pas. (8) | C | | T/C | | | G/T | | | C | | |
| Amino acid position | | | | | | | | | | | | |
| Recombinant specific | 776 | 832 | 881 | 1463 | 1468 | 1664 | 1664 | 1676 | 1931 | 2439 | 2736 | 2977 |
| H77 ref (AF009606) | 772 | 828 | 877 | 1459 | 1464 | 1660 | 1660 | 1672 | 1927 | 2417 | 2714 | 2955 |
| Change | F-S | L-P | V-I | T-A | F-L | W-S | W-C | A-S | N-S | V-F | * | * |

| HCV Gene | E1 | p7 | NS3 | NS3 | NS4A | NS5A | NS5B | NS5B | NS5B | NS5B | NS5B | NS5B | VR |
|---|---|---|---|---|---|---|---|---|---|---|---|---|---|
| Nucleotide position | | | | | | | | | | | | | |
| Recombinant specific | 1325 | 2667 | 3706 | 4742 | 5366 | 7656 | 9086 | 9102 | 9216 | 9342 | 9348 | 9458 | |
| H77 ref. (AF009606) | 1326 | 2656 | 3695 | 4731 | 5355 | 7501 | 9021 | 9037 | 9151 | 9277 | 9283 | 9397 | |
| J6CF | A | T | A | T | G | T | C | C | G | A | A | C | |
| J6CF mutant | Exp. (day) | | | | | | | | | | | | |
| J6_7mVmΔ33U# | Transf. (27) | | C | | C | | | A | A | G/a | T | G | |
| J6_4mVmΔ33U | 4th pas. (5)* | T/a | C | G/A | C | T | C/T | | | G | T | G | |
| J6_3mVmΔ33U | 1st pas. (18) | | | | C | T | | | | G | T | G | |
| Amino acid position | | | | | | | | | | | | | |
| Recombinant specific | 329 | 776 | 1122 | 1468 | 1676 | 2439 | 2916 | 2921 | 2959 | 3001 | 3003 | | |
| H77 ref. (AF009606) | 329 | 772 | 1118 | 1464 | 1672 | 2387 | 2894 | 2899 | 2937 | 2979 | 2981 | | |
| Change | T-S | F-S | * | F-L | A-S | V-A | L-M | H-P | R-K | D-G | Y-F | • | |

Fig. 5 (Table 2)

Fig. 6 (Table 3)

Fig. 7
(Table 4)

| HCV gene | E1 | p7 | p7 | NS2 | NS2 | NS3 | NS5A | NS5A | NS5B | NS5B | NS5B | NS5B | NS5B |
|---|---|---|---|---|---|---|---|---|---|---|---|---|---|
| Nucleotide position | | | | | | | | | | | | | |
| Recombinant specific | 1325 | 2658 | 2667 | 2937 | 2949 | 4541 | 7006 | 7451 | 7636 | 7661 | 7814 | 8968 | 9342 |
| H77 ref (AF009606) | 1326 | 2647 | 2656 | 2926 | 2938 | 4530 | 6995 | 7437 | 7591 | 7696 | 7749 | 8903 | 9277 |
| Nucleotide | A | T | T | C | T | A | C | G | T | T | A | G | A |
| J6/JFH1 recombinant | Exp. (day) | | | | | | | | | | | | |
| J6_5ABfin | 1st pas. (13) | | | | | | | T/C | | | | | |
| J6_5ABpal | 1st pas. (13) | | | | | | | T/C | | A/C | | | |
| J6_5ABthu431 | 1st pas. (10) | C | | T | | | A/G | C/T | | | | G/A | |
| J6_5ABthu464 | 1st pas. (6) | T | | T/C | | | | G/T | | | | | G |
| Amino acid position | | | | | | | | | | | | | |
| Recombinant specific | 329 | 773 | 776 | 866 | 870 | 1401 | * | 2222 | 2439 | 2441 | 2492 | 2876 | 3001 |
| H77 ref (AF009606) | 329 | 769 | 772 | 862 | 866 | 1397 | 2218 | 2366 | 2417 | 2452 | 2470 | 2854 | 2979 |
| Change | T-S | V-A | F-S | P-L | V-A | K-E | • | D-Y | V-A | C-R | K-Q | M-I | D-G |

Fig. 8 (Table S1)

| HCV Gene | E1 | E2 | E2 | p7 | p7 | NS3 | NS3 | NS3 | NS3 | NS3 | NS3 | NS4A | NS4B | NS4B | NS5A | NS5A | NS5A | NS5A |
|---|---|---|---|---|---|---|---|---|---|---|---|---|---|---|---|---|---|---|
| Nucleotide position | | | | | | | | | | | | | | | | | | |
| Recombinant specific | 1131 | 1686 | 2613 | 2607 | 2722 | 3925 | 4742 | 4744 | 4913 | 5366 | 5698 | 6132 | 6338 | 6352 | 7432 | 7649 |
| H77 ref (AF009606) | 1132 | 1687 | 2602 | 2656 | 3711 | 3914 | 4731 | 4733 | 4902 | 5355 | 5687 | 6121 | 6327 | 6341 | 6471 | 7429 | 7604 |
| Nucleotide | T | C | T | T | A | G | T | C | T | G | A | A | A | C | T | C | G |
| J6(JFH1_5Bthu X) | | | | | | | | | | | | | | | | | |
| +F1468L[a] | Transf (23) | T/C | G | C | | | C | | | | | | | | | | |
| +A1676S[a] | 1st pas. (20) | | | | | C | | | | T | | | | T/A | | G/C |
| +F776S/A1676S[a] | 1st pas. (18) | | | | C | A/T | G/C | | C/G | | T | A/G | A/G | G/a | | | |
| +F1468L/A1676S[a] | 1st pas. (18) | | | | | | | C | | T/C | T | | | | C/T | | |
| +F776S/F1468L/A1676S[a] | 1st pas. (21) | | | | C | | | C | | | T | | | | | G | |
| Amino acid position | | | | | | | | | | | | | | | | | | |
| Recombinant specific | 264 | 449 | 758 | 776 | 1128 | 1195 | 1468 | 1468 | 1523 | 1676 | 1786 | 1931 | 2000 | 2004 | 2048 | 2437 |
| H77 ref (AF009606) | 264 | 449 | 754 | 772 | 1124 | 1191 | 1464 | 1464 | 1521 | 1672 | 1782 | 1927 | 1996 | 2000 | 2044 | 2363 | 2421 |
| Change | M-T | S-W | L-S | F-S | T-S | * | F-L | F-L | Y-H | A-S | * | N-S | T-A | P-S | M-L | * | D-H |

Fig. 9
(Table S2)

| HCV Gene | p7 | NS3 | NS4A | NS5A | NS5A | NS5A | NS5A | NS5A | NS5B |
|---|---|---|---|---|---|---|---|---|---|
| Nucleotide position | | | | | | | | | |
| Recombinant specific | 2667 | 4742 | 5366 | 7398 | 7536 | 7643 | 7656 | | 9341 |
| H77 ref. (AF009606) | 2656 | 4731 | 5353 | 7399 | 7525 | 7581 | 7591 | | 9276 |
| Nucleotide | | | | | | | | | |
| J6 recombinant | T | T | G | G | | | T | G | G |
| J6(JFH1_5Bthu372-591)F776S/F1468L/A1676S* 1st pas. (15) | C | C | T | | | | | | |
| J6(JFH1_5Bthu465-591)F776S/F1468L/A1676S* Transf. (23) | C | C | T | G/T | T/C | G/A | C/T | | |
| J6(JFH1_5Bthu372-554)F776S/F1468L/A1676S# Transf. (25) | C | C | T | | | | | | G/A |
| Amino acid position | | | | | | | | | |
| Recombinant specific | 776 | 1468 | 1676 | 2353 | 2399 | 2435 | 2439 | | 3001 |
| H77 ref. (AF009606) | 772 | 1464 | 1672 | 2353 | 2395 | 2414 | 2417 | | 2979 |
| Change | F-S | F-L | A-S | G-V | L-P | Q-K | V-A | | D-N |

Fig. 10 (Table S3)

Fig. 11 (Table S4)

Fig. 11 continued (Table S4)

Fig. 12 (Table S5)

| Virus | Sequence | Reaction | Primer | Sequence (5' to 3') |
|---|---|---|---|---|
| J6 | ORF | Reverse transcription | J6R9458 | AAAAGGGACAGTTAGCTATGGAGTGTAG |
| | | First PCR | 5'UTRF40 | CTCCCTGTGAGGAACTACTGTCTTCACGC (68) |
| | | | J6R9449 | AGGGACAGTTAGCTATGGAGTGTAATGTGT |
| | | Nested-PCR | | |
| | | Amplicon 1 | J6F73 | AGCGTCTAGCCATGCGTTAGTAT |
| | | | J6R1327 | CGTGGGCGACCAGTTCATCAT |
| | | Amplicon 2 | J6F1244 | CAAGACTGCAATTGCTCCATCTACC |
| | | | J6R2678 | GGACTACCGACCCTTGATGTACCA |
| | | Amplicon 3 | J6F2446 | CGTACAATTCATGTATGCCTATCACC |
| | | | J6R3702 | CGTGCACGGCTCCAAAGATTTAG |
| | | Amplicon 4 | J6F3657 | CCAGTGCTGAGGGGACTTAGTAGG |
| | | | J6R5052 | TGGGAAGGAAGTGGGCATCTATGT |
| | | Amplicon 5 | 4528S_J6 | GAGCGGAGCCTCAGGAATGTTGACA |
| | | | J6R5681 | GTTCCCTGGCAGTGTTGATAGTCC |
| | | Amplicon 6 | J6F5606 | GCTTCATGGCCCAAGGTAGAAC |
| | | | J6R7034 | CCCCATGAACAGGTTAGCATC |
| | | Amplicon 7 | J6F6842 | CCTGAACCCGACACAGAGTATTGA |
| | | | J6R8142 | GACGCGAGGTCAGGGTAAAGATAA |
| | | Amplicon 8 | 7741S_J6 | ATGGCCAAAATGAGGTGTTCTGC |
| | | | J6R9440 | TATGGAGTGTAGCTAATGTGTGCGCTCTA |
| 3'UTR* | | Reverse transcription | JFH1R427 | GCGGTGAAGACCAAGCTCAAACTC (30) |
| | | First PCR | J6F9300 | TGGATTTATCCAGCTGGTTCACGTCG |
| | | Second PCR | J6F9375 | GCTTATTGCTCTTGGCCTACTCCT |

Fig. 13 (Table S6)

| | | | |
|---|---|---|---|
| J8 | ORF | Reverse transcription | | |
| | | Reaction 1 | 2b_5777R | CCATGATGTTCAAGAGGATGG |
| | | Reaction 2 | 2b_9470R(24) | CTATGGAGTGTAGCTAGGGTTTGC |
| | | First PCR | | |
| | | Amplicon 1 | UN140 | ACTGTCTTCACGCAGAAAGCGTCTAGCCAT |
| | | | 2b_5480R | CTTCCATCTCATCAAGGCC |
| | | Amplicon 2 | 2b_3763 | CGAAACGCTGATGTCATTCC |
| | | | J8R9446-22b | GGAGTGTAGCTAGGGTTTGCCG |
| | | Nested-PCR | | |
| | | Amplicon 1 | J8F283 | GTGGTACTGCCTGATAGGGTGCTT |
| | | | J8R1063 | TCACAGCCACGTTGGGTGTTACTT |
| | | Amplicon 2 | J8F815 | GGAGGAACGGGATAAATTACGCAACAG |
| | | | J8R2232 | TCCTACATACATCCGGCCTTAAA |
| | | Amplicon 3 | J8F2186 | CCCTTATAGATGTGGCATTATCCGT |
| | | | J8R3182 | TCGTAGATGTAAGTGCCGTCCAT |
| | | Amplicon 4 | J8F3096 | GCCCACGCTTTGCTACGAGTGT |
| | | | J8R4108 | CCGCGACAGCAGCGATTAGTACGA |
| | | Amplicon 5 | J8F3696 | CCCGGACTAAGTCACCACGTCTC |
| | | | J8R4642 | GGCGACAACCACCACGTCTC |
| | | Amplicon 6 | J8F4605 | TATAGGGTCTGACGTCTCCGTT |
| | | | J8R6250 | GAGCATGGGACTGGCAATCTT |
| | | Amplicon 7 | J8F6096 | TGGATGAACAGACTGATCGCCTTC |
| | | | J8R7301 | GTGGAGGCACTGGCGTTGA |
| | | Amplicon 8 | J8F7238 | GACATGGAAGAGCCCGGCTAT |
| | | | J8R8770 | GTCCAGGGCTACCGATACGTTTG |
| | | Amplicon 9 | J8F8401 | TGCCTCAAGAAGCCAGAACTGTC |
| | | | J8R9446-22b | GGAGTGTAGCTAGGGTTTGCCG |
| | 3'UTR* | Reverse transcription | J8F9107 | CGAAACTCTCAGGGTGGCAGC |
| | | First PCR | J8F9275 | CACTCCATTGCCCGAGGGAG |
| | | Second PCR | J8F9334 | GCGGGGGCGGCATTTATCACA |

Fig. 13 continued (Table S6)

| HCV | Peak FFU/ml, log₁₀ | | | Nucleotide position | | | | | | | | | | | |
|---|---|---|---|---|---|---|---|---|---|---|---|---|---|---|---|
| | Transf. (day) | First passage | Day sequenced | NS3 | NS3 | NS4A | NS4B | NS4B | NS4B | NS5B | NS5B | NS5B | NS5B | | |
| Nucleotide position | | | | | | | | | | | | | | | |
| Recombinant specific | | | | 4018 | 4731 | 5355 | 5634 | 5660 | 6121 | 9277 | 9283 | 9322 | | | |
| H77 reference (AF009606) | | | | 4018 | 4731 | 5355 | 5634 | 5660 | 6121 | 9277 | 9283 | 9322 | | | |
| Recombinant nucleotide | | | | C | T | G | A | A* | A | A† | | | | | |
| TN(JFH1_5BX) | | | | | | | | | | | | | | | |
| +LSG, exp. 1 | 4.2 (31) | 4.4 | 11 | G/c | C | T | . | . | . | G | T | (T) | | | |
| +LSG, exp. 2 | 4.4 (31) | 4.4 | 11 | G | C | T | . | . | . | G | T | (T) | | | |
| +LSG/A1226G | 4.5 (6) | 4.5 | 8 | G | C | T | . | . | . | G | T | (T) | | | |
| +LSG/A1226G/Q1773H | 4.1 (8) | 3.9 | 8 | G | C | T | A/g | C/a | A/c | G | T | (T) | | | |
| +LSG/Q1773H | 3.5 (18) | 5.0 | 9 | G/c | C | T | . | Ca/t | . | G | T | (T) | | | |
| TN full-length | | | | | | | | | | | | | | | |
| +LSG/A1226G/Q1773H‡ | 3.6 (12) | 4.9 | 7 | G | C | T | A/g | C/a | A/c | G | T | T/C | | | |
| +LSGFA1226G, exp. 1§ | 3.8 (17) | 4.6 | stock? | G | C | T | A/g | . | A/g | G | T | T/c | | | |
| +LSGFA1226G, exp. 2 | 3.1 (14) | 4.5 | 11 | G | C | T | . | . | A/g/c | G | T | T/c | | | |
| +LSGFA1226G/Q1773H/F2948 | 3.9 (5) | 4.7 | 7 | G | C | T | A/G | A/G/c | . | G | T | C | | | |
| +LSGFA1226G/N1927F/F2948 | 4.3 (5) | 4.6 | 7 | G | C | T | . | . | G | G | T | C | | | |
| +LSGFA1226G/Q1773H/N1927F/F2948 | 4.4 (5) | 4.6 | 7 | G | C | T | . | C | G | G | T | C | | | |
| +LSGFA1226G/Q1773H/N1927F/F2948 | 4.9 (5) | 4.6 | 7 | G | C | T | . | C | G | G | T | C | | | |
| +LSGFA1226G/Q1773H/N1927F/F2948 (TNcc) | 4.8 (5) | 4.7 | 7 | G | C | T | . | C | G | G | T | C | | | |
| Amino acid position | | | | | | | | | | | | | | | |
| Recombinant specific | | | | 1226 | 1464 | 1672 | 1765 | 1773 | 1927 | 2979 | 2981 | 2994 | | | |
| H77 reference (AF009606) | | | | 1226 | 1464 | 1672 | 1765 | 1773 | 1927 | 2979 | 2981 | 2994 | | | |
| Amino acid change | | | | A-G | F-L | A-S | M-V | Q-H | N-S/T | D-G | Y-F | F-S | | | |

HCV FULL-LENGTH INFECTIOUS CELL CULTURE SYSTEMS AND APPLICATIONS THEREOF

CROSS REFERENCE TO RELATED APPLICATIONS

This application is a U.S. National Phase Application of PCT International Application Number PCT/DK2013/050070, filed on Mar. 15, 2013, designating the United States of America and published in the English language, which is an International Application of and claims the benefit of priority to U.S. Provisional Application No. 61/613,138, filed on Mar. 20, 2012, and U.S. Provisional Application No. 61/722,675, filed on Nov. 5, 2012. The disclosures of the above-referenced applications are hereby expressly incorporated by reference in their entireties.

REFERENCE TO SEQUENCE LISTING

A Sequence Listing submitted as an ASCII text file via EFS-Web is hereby incorporated by reference in accordance with 35 U.S.C. §1.52(e). The name of the ASCII text file for the Sequence Listing is SeqList_PLOUG165_001APC.txt, the date of creation of the ASCII text file is Sep. 16, 2014, and the size of the ASCII text file is 3043 KB.

TECHNICAL FIELD OF THE INVENTION

The present invention relates to nucleic acid sequences that encode hepatitis C viruses (HCV) that are useful in the fundamental research of HCV as well as in the search of drug candidates and a vaccine against HCV. In particular the present invention relates to nucleic acid sequences that comprises HCV, which are capable of expressing said virus when transfected into cells and/or are capable of infectivity in vivo.

BACKGROUND OF THE INVENTION

Hepatitis C is one of the most widespread infectious diseases in the world. About 180 million people are infected with hepatitis C virus (HCV) worldwide with a yearly incidence of 3-4 million.

While the acute phase of infection is mostly asymptomatic, the majority of acutely infected individuals develops chronic hepatitis and is at increased risk of developing liver cirrhosis and hepatocellular carcinoma.

Thus, HCV infection is a major contributor to end-stage liver disease and in developed countries to liver transplantation.

HCV is a small, enveloped virus classified as a member of the Flaviviridae family. Its genome consists of a 9.6 kb single stranded RNA of positive polarity composed of 5' and 3' untranslated regions (UTR) and one long open reading frame (ORF) encoding a polyprotein, which is co- and post-translationally cleaved and thus yields the structural (Core, E1, E2), p7 and nonstructural (NS2, NS3, NS4A, NS4B, NS5A, NS5B) proteins.

HCV isolates from around the world exhibit significant genetic heterogeneity. At least 7 major HCV genotypes (genotypes 1-7) have been identified, which differ by 31-33% at the nucleotide level and deduced amino acid level.

In addition, there are numerous subtypes (a, b, c, etc.), which differ by 20-25% on the nucleotide and deduced amino acid level.

Since its discovery in 1989, research on HCV has been hampered by the lack of appropriate cell culture systems allowing for research on the complete viral life cycle as well as new therapeutics and vaccines.

In 2001, a genotype 2a isolate (JFH1) was described, which subsequently was found to yield high RNA titers in the replicon system without adaptive mutations.

A major breakthrough occurred in 2005, when formation of infectious viral particles was reported after transfection of RNA transcripts from the JFH1 full-length consensus cDNA clone into Huh7 cells.

At the same time, it was demonstrated that the intragenotypic 2a/2a recombinant genome (J6/JFH1), in which the structural genes (Core, E1, E2), p7 and NS2 of JFH1 were replaced by the respective genes of clone J6CF, produced infectious viral particles in Huh7.5 cells (a cell line derived from bulk Huh7 cells) with an accelerated kinetic.

Cell culture derived J6/JFH viruses were apparently fully viable in vivo.

Despite the importance of the described cell culture systems they represent only a single isolate (genotype 2a) of HCV.

It is important to develop cell culture systems for representative strains of other HCV isolates, subtypes and genotypes, since neutralizing antibodies are not expected to cross-neutralize all genotypes and new specific antiviral compounds have differential efficiencies against different isolates, subtypes and genotypes.

To date, only the JFH1 (genotype 2a) clone could autonomously replicate and release infectious virus in cultured human hepatoma cells, Huh7 and Huh7.5; its efficient growth depended on mutations.

A JFH1 chimera with the 5'UTR-NS2 region from another genotype 2a strain cDNA clone, J6CF, had enhanced infectivity.

Besides, an H77 (genotype 1a) clone containing replicon-derived mutations was shown to produce infectious virus particles.

To facilitate HCV research and obtain basic knowledge for better and individualized treatment, the present inventors have aimed at developing culture systems for other HCV patient isolates.

Hence, improved and alternative HCV genomes of all genotypes, which are capable of expressing said virus when transfected into cells and are capable of infectivity in vivo, would be advantageous.

SUMMARY OF THE INVENTION

Thus, an object of the present invention relates to nucleotide sequences that encode HCV that are useful in the fundamental research of HCV as well as in the search of drug candidates and a vaccine against HCV.

In particular, it is an object of the present invention to provide nucleotide sequences of HCV which are capable of expressing said virus when transfected into cells and are capable of infectivity in vivo.

Thus, one aspect of the invention relates to an isolated nucleic acid molecule which encodes a human hepatitis C virus wherein the hepatitis C virus is derived from genotype 2b, isolate J8_LSG and has a nucleic acid sequence with 90% sequence identity to isolate J8_LSG (SEQ ID NO:41).

Another aspect of the invention relates to an isolated nucleic acid molecule which encodes a human hepatitis C virus wherein the hepatitis C virus is derived from genotype 2a and is isolate J6cc (SEQ ID NO:39) and has a nucleic acid sequence with 90% sequence identity to isolate J6cc (SEQ ID NO:39).

Another aspect of the invention relates to an isolated nucleic acid molecule which encodes a human hepatitis C virus wherein the hepatitis C virus is derived from genotype 1a and is isolate TNcc (SEQ ID NO:145) and has a nucleic acid sequence with 90% sequence identity to isolate TNcc (SEQ ID NO:145).

Another aspect of the present invention relates to an isolated nucleic acid molecule which encodes a human hepatitis C virus, wherein said molecule is capable of expressing said virus when transfected into cells, is capable of infectivity in vivo, comprises at least one adaptive mutation in the amino acid sequence of NS3, which is F1468L, comprises at least one adaptive mutation in the amino acid sequence of NS4A which is A1676S, and comprises at least one adaptive mutation in the amino acid sequence of NS5B which is D3001G.

Yet another aspect of the present invention is to provide vectors, cells, compositions and viral particles that comprise the nucleic acids sequences of the present invention.

Still other aspects of the present invention are to provide methods for producing a hepatitis C virus particle, for in vitro producing a hepatitis C virus-infected cell, for screening an anti-hepatitis C virus substance and for producing a hepatitis C virus vaccine.

(A) J6/JFH1 with J6 NS5A-to-NS5B thumb domain was viable in Huh7.5 cells. Illustrations: JFH1, J6CF and J6/JFH1 recombinants. The NS5B finger [amino acid (aa)1-188], finger-palm (aa1-371), and finger-thumb (aa1-431 and aa1-464) domains of J6/JFH1 were replaced with J6 sequences. Graphs: RNA transcripts of J6/JFH1-based recombinants were transfected into Huh7.5 cells, and HCV core antigen was detected by immunostaining, and percentage positive cells was estimated (left y-axis). HCV infectivity titers in supernatant at peak infection (≥80% HCV positive cells) were determined by focus forming unit (FFU) assay (mean of triplicate infections±SEM, right y-axis). J6/JFH1 was included for comparison. (B) J6 recombinant with JFH1 thumb domain-to-3'UTR was viable. Huh7.5 cells were transfected with J6CF recombinants with JFH1 NS5B-to-3'UTR or partial NS5B-to-3'UTR. J6$^{5'UTR\text{-}NS2}$/JFH1 was used as positive control. J6(JFH1_5BpalX) was from a separate experiment. Experimental details as in (A). (C) Mutations F776S (in p7), F1468L (NS3 helicase) and A1676S (NS4A), identified by analysis of viruses shown in B and Table 1, enhanced J6(JFH1_5BthuX) production in transfected Huh7.5 cells. J6$^{5'UTR\text{-}NS2}$/JFH 1, positive control. Experimental details as in (A). (D) NS5B aa465-591 within the thumb domain was the minimal JFH1 element required for adaptation of the J6CF with mutations F776S/F1468L/A1676S. J6 recombinants with F776S/F1468L/A1676S, in which different regions of the NS5B thumb domain were replaced by JFH1 sequences, were tested in Huh7.5 cells. J6$^{5'UTR\text{-}NS2}$/JFH1, positive control. Experimental details as in (A). J6CFF776S/F1468L/A1676S had no evidence of HCV infection during 41 days post-transfection.

Figure 2:
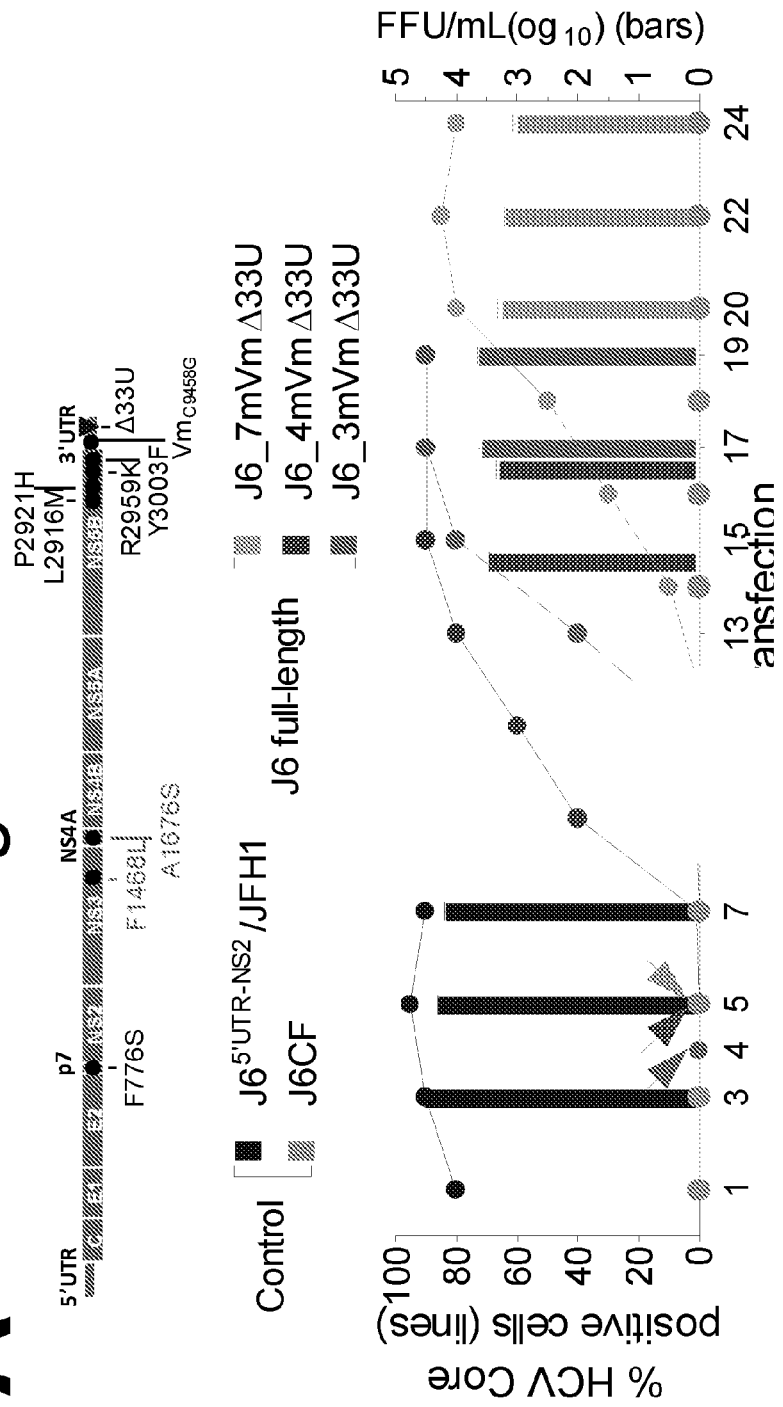
Figure 2:
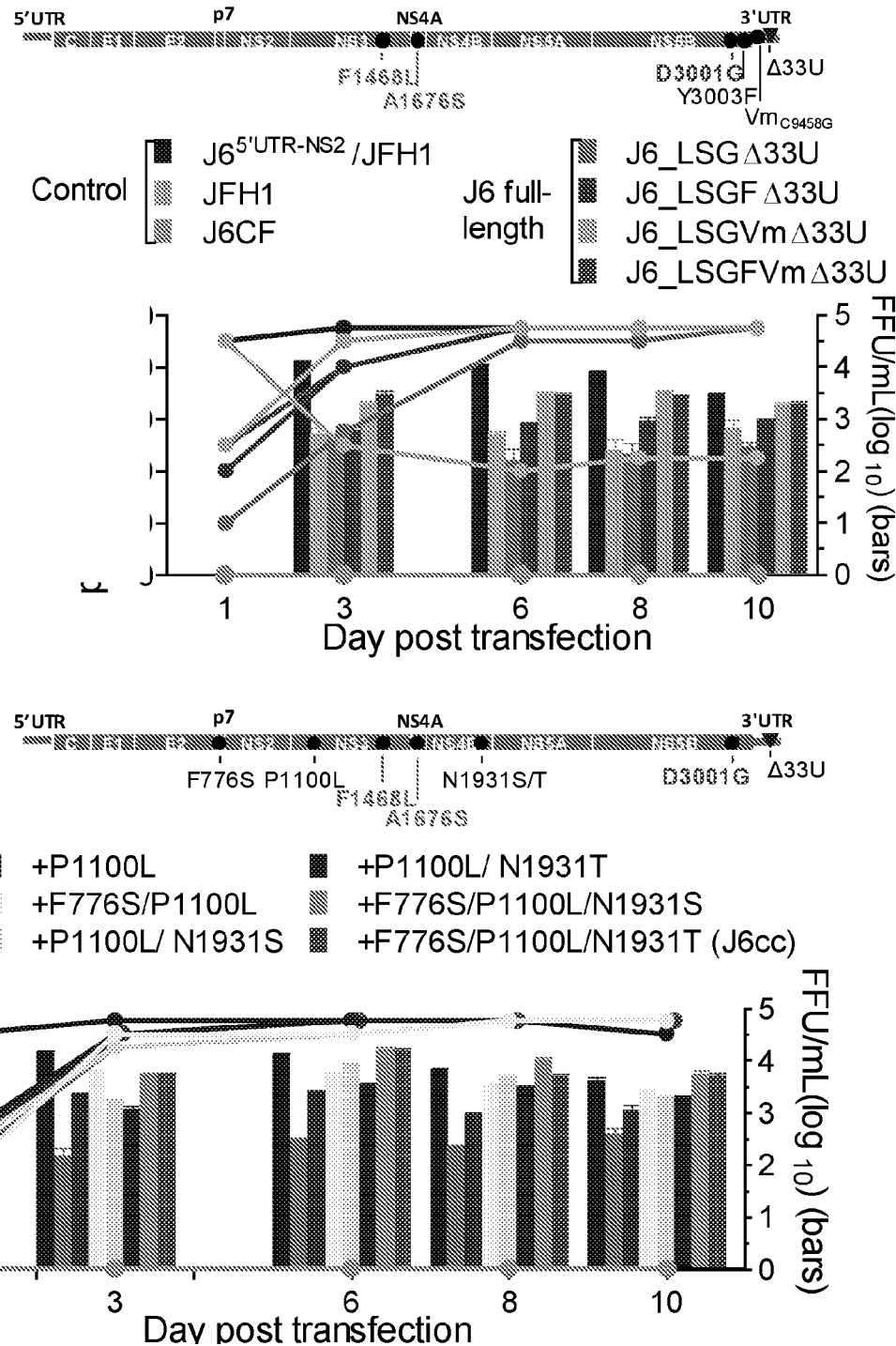
Figure 2:
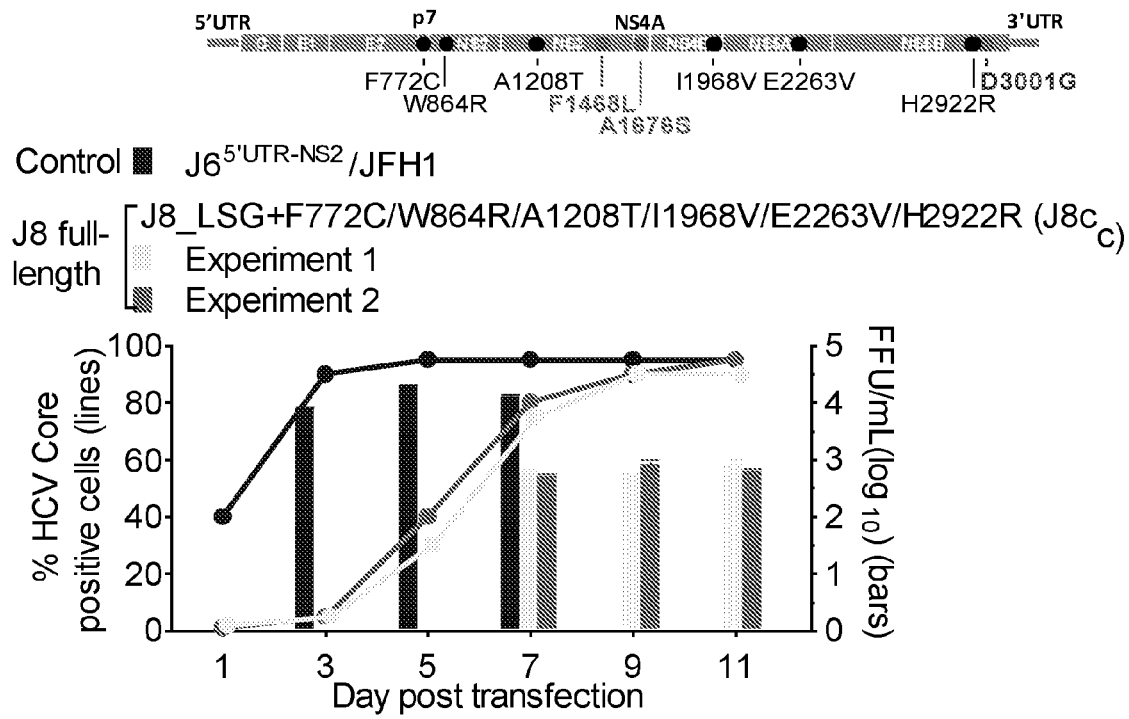

FIG. 2 shows development of J6 and J8 full-length culture systems.

Figure 1:
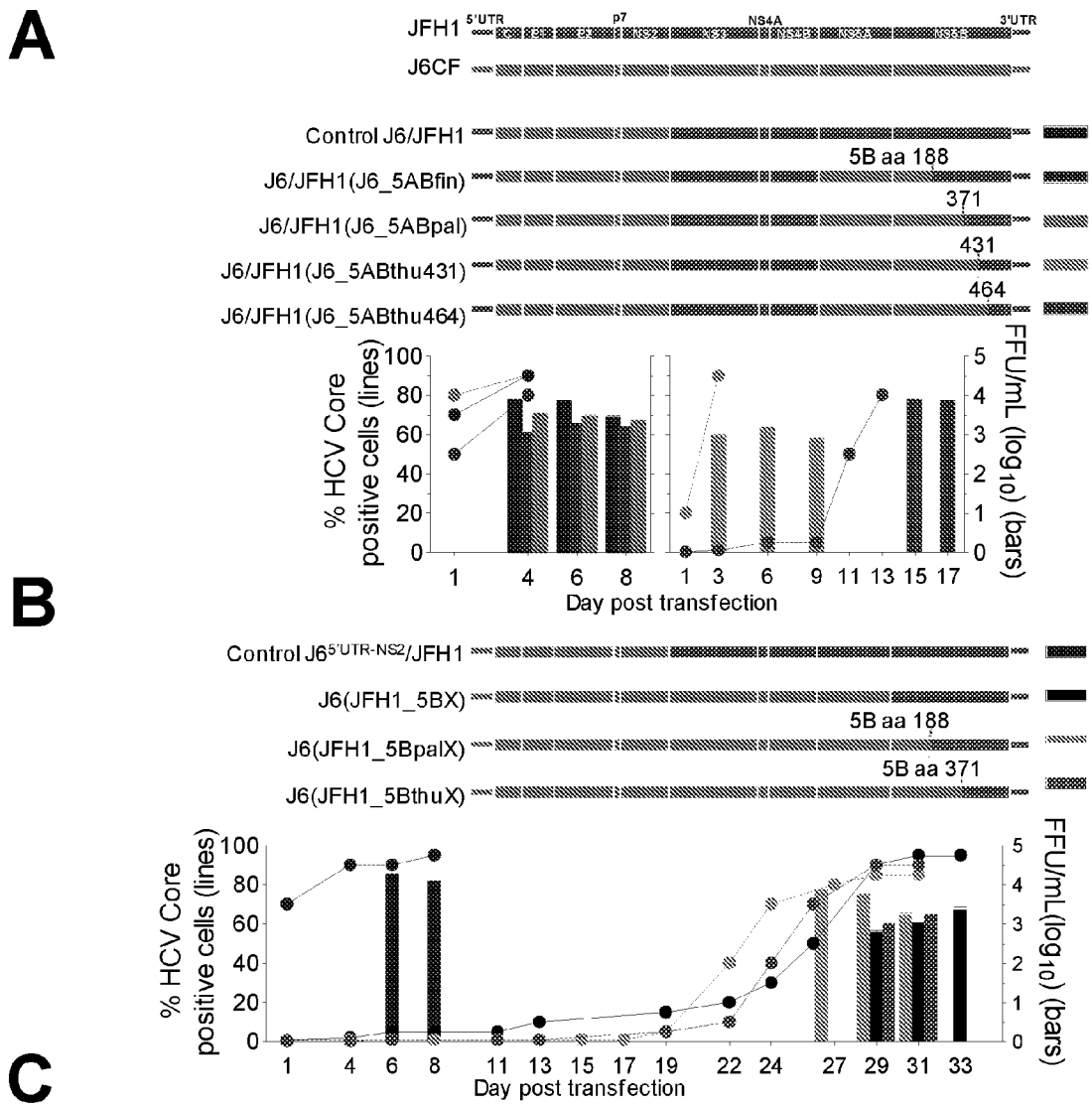
FIG. 1 shows analysis of in vitro viability of J6 recombinants with minimal JFH1 sequences.

RNA transcripts of HCV genomes with indicated mutations (genome illustrations) were transfected into Huh7.5 cells (graphs), and estimated percentage of HCV positive cells (left y-axis) and peak HCV infectivity titers (right y axis) were determined. J6$^{5'UTR\text{-}NS2}$/JFH1, positive control. (A) Long-term culture adaptation of J6CF with mutations. Arrows, day HCV positive cells emerged. 7m, F776S/F1468L/A1676S/L2916M/P2921H/R2959K/Y3003F; 4m, F776S/F1468L/A1676S/Y3003F; 3m, F1468L/A1676S/Y3003F; Vm, C9458G; and Δ33U, 33 U deletion in polyU/UC tract. Data were from three different experiments with a representative J6$^{5'UTR\text{-}NS2}$/JFH1 shown. J6_Y3003FVmΔ33U and J6_Δ33U remained HCV negative through 40 and 33 days, respectively. (B) Combination of F1468L/A1676S/D3001G (LSG) and Δ33U enabled J6 full-length to efficiently produce infectious particles. Mutations F1468L (NS3 helicase) and A1676S (NS4A) were identified by analysis of viruses shown in FIG. 1B and Table 1 and D3001G (NS5B) was identified by analysis of viruses shown in A and Table 2 F, Y3003F. Wild-type JFH1 and J6CF were included for comparison. (C) Mutations F776S, P1100L and N1931S/T, identified by analysis of J6_LSGΔ33U viruses shown in B and Table 3, adapted J6_LSGΔ33U reaching HCV infectivity titers>$10^4$ FFU/mL. *, titer<$1.7 \log_{10}$(FFU/mL). (D) Mutations adapting J6 enhanced replication and assembly of intracellular infectious HCV particles. RNA transcripts were transfected into HCV entry-deficient S29 cells. HCV core level at 48 hours (relative to 4 hours) was normalized to that of replication-negative J6/JFH1_GND (arbitrary value as 1). #, no FFU detected. (E) Efficient full-length J8 culture system based on F1468L/A1676S/D3001G mutations and further adaptation. Transfection of J8_LSG with additional mutations F772C/W864R/A1208T/I1968V/E2263V/H2922R, identified by analysis of J8_LSG derived viruses (Table 4 and Table S4), yielded rapid spread and significant infectivity titers. Infectivity titers increased after passage to naïve Huh7.5 cells and recovered viruses did not have other mutations (Table 4).

Figure 3:
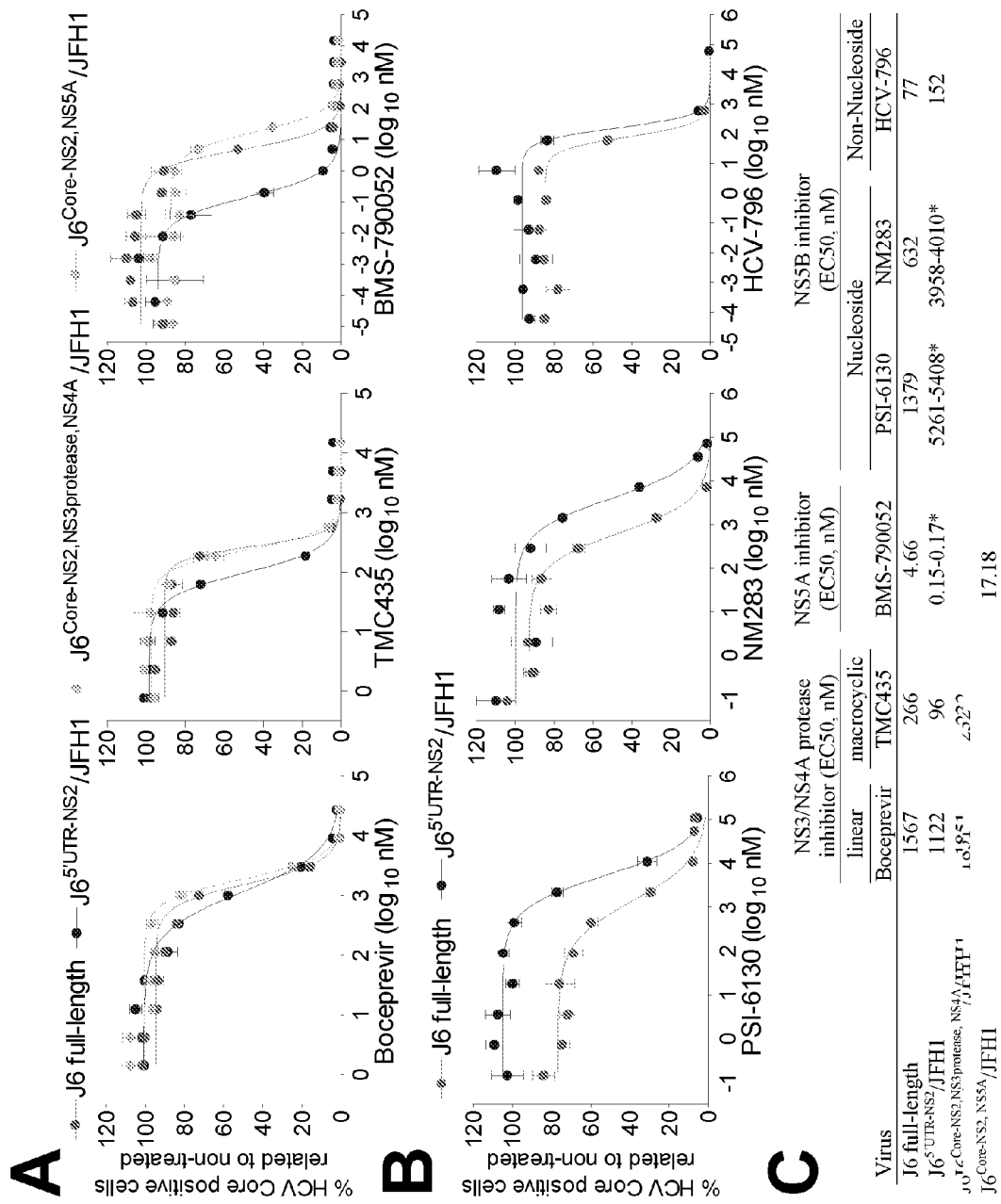

FIG. 3 shows dose-dependent efficacy of NS3/NS4A protease, NS5A and NS5B polymerase inhibitors against J6 full-length virus and JFH1-based recombinants with J6-specific elements.

Naïve Huh7.5 cells were infected with indicated viruses, and antiviral treatments were carried out at 24 and 48 hours post-infection. The HCV positive cells were counted 72 hours post-infection as previously described. Fourth passage J6 full-length J6_LSGΔ33U virus (Table 3) was used for treatment. Treatment experiments with recombinants J6$^{5'UTR\text{-}NS2}$/JFH1, J6$^{Core\text{-}NS2,NS3\ protease,\ NS4A}$/JFH1 and J6$^{Core\text{-}NS2,NS5A}$/JFH1 were included for comparison. (A) Treatment with protease inhibitors (boceprevir and TMC435) and the NS5A inhibitor daclatasvir (BMS-790052). (B) Treatment with NS5B inhibitors. (C) Median effective concentrations (EC50) of the used inhibitors against the indicated viruses. *, range of two experiments; experiments with the lowest EC50 shown in A or B. In A and B, values are means of triplicate determinations.

FIG. 4 (Table 1) shows sequence analysis of J6 recombinants with JFH1 complete or partial NS5B-to-3'UTR.

Transfection-derived J6 recombinants (FIG. 1B) were passaged to naïve Huh7.5 cells, and culture supernatant collected at peak infection (≥80% cells infected) was subjected to RNA extraction and RT-PCR for HCV ORF sequence analysis. Nucleotide and amino acid positions of the specific recombinant with mutations are listed; the corresponding position of H77 reference sequence (AF009606) is given. Two capital letters separated by a slash indicates a nucleotide quasispecies (50/50), while a capital letter separated from a lowercase letter indicates a dominant/minor sequencing read. ●, No amino acid change. *, the sequence of the 5'UTR of recovered virus was determined by 5'RACE procedure using HCV RNA extracted from infection supernatant, the G inserted immediately before the 5'-terminal nucleotide A for enhancing in vitro transcription was deleted, consistent with our previous observations in JFH1-based culture systems; no changes were observed in the 5'UTR.

FIG. 5 (Table 2) shows sequence analysis of J6 full-length genome with mutations recovered from long-term cultures.

Transfection- or first passage-recovered viable J6 recombinants (transfection in FIG. 2A) with different engineered mutations were subjected to ORF and 3'UTR sequence analysis. See Table 1 legend for details on annotations on nucleotides. Shadings indicate the engineered mutations. ●, no amino acid change. #, six U were deleted in the polyU/UC tract of the final construct plasmid. *, the first, second and third passage viruses were not sequenced. Mutations introduced into J6CF: 7m, F776S/F1468L/A1676S/L2916M/P2921H/R2959K/Y3003F; 4m, F776S/F1468L/A1676S/Y3003F; 3m, F1468L/A1676S/Y3003F; Vm, nucleotide change C9458G in 3'UTR variable region (VR), and Δ33U, 33 U in polyU tract deleted. The 3'UTR of recovered virus was determined by 5'RACE on HCV negative RNA strand, no consensus changes were observed in the variable and 3'-X regions. The length of the polyU/UC tract was found to be variable among analyzed clones: recombinants with 7m, 4m and 3m mutations were on average 6 (7 clones with 3 U insertions to 15 U deletions) and 8 (6 clones with 7 U insertions to 19 U deletions) nucleotides shorter and 4 (7 clones with 19 insertions to 6 U deletions) nucleotides longer than the original polyU/UC tract, respectively.

Figure 6:
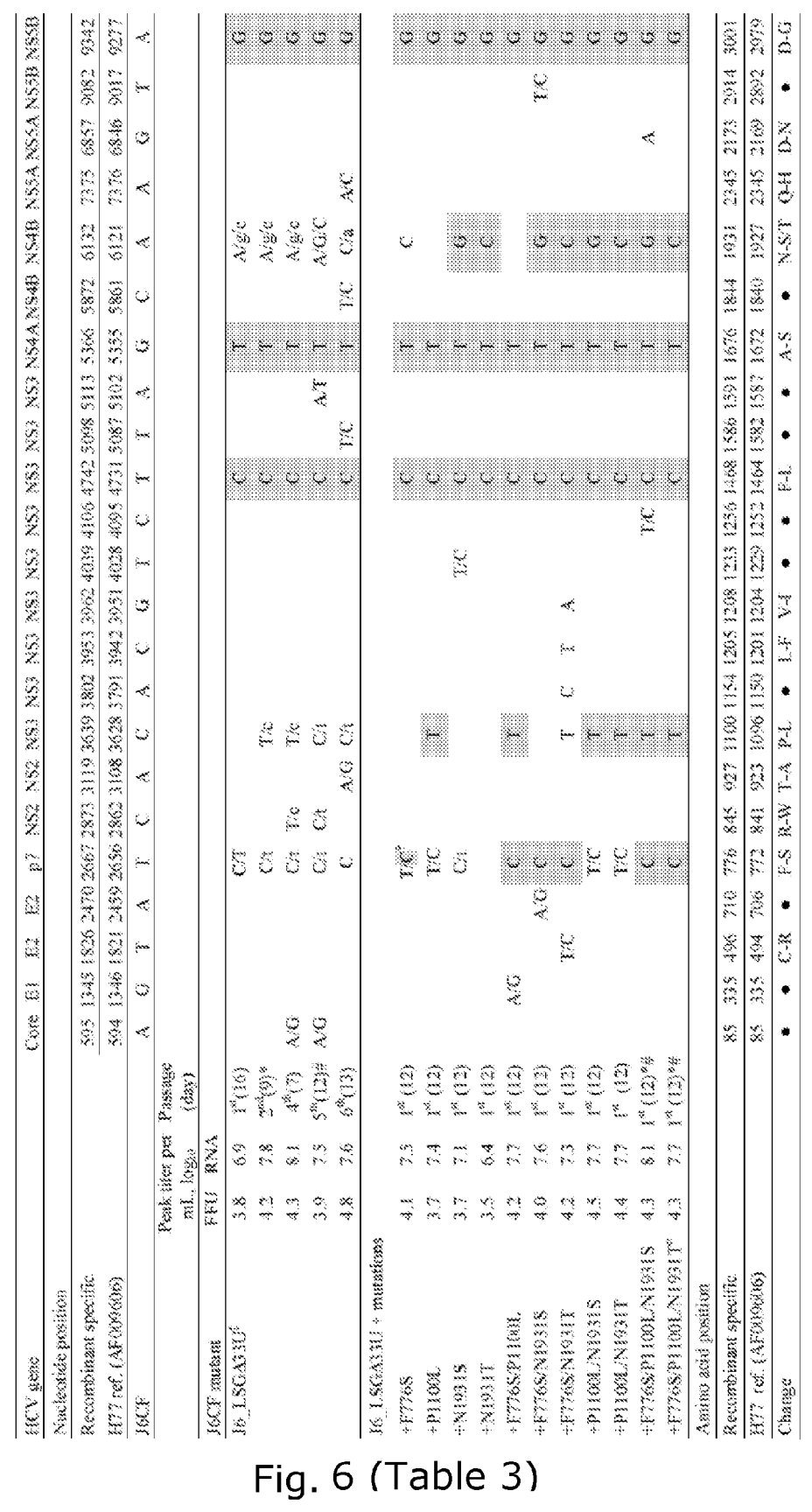

FIG. 6 (Table 3) shows analyses of the recovered J6_LSGΔ33U viruses. For each passaged J6_LSGΔ33U (original transfection shown in FIG. 2B) and its derived viruses with additional mutations (transfection in FIG. 2C) a representative peak infectivity titer (FFU/ml) with associated HCV RNA titer (IU/ml) is shown. Viruses from the indicated passage day were sequenced for ORF. Shadings indicate the engineered mutations. See Table 1 legend for details on annotations on nucleotides. ●, no amino acid change. †, engineered C was partially reverted. *, the 5'UTR was determined by 5'RACE, no change was identified in the 5'UTR; however, the G inserted immediately before the 5'-terminal A for enhancing in vitro-transcription was deleted, consistent with our previous observations in JFH1-based systems. #, the 3'UTR was determined by 5'RACE on HCV negative RNA strand; no consensus changes were found in variable and 3'-X regions, however, the polyU/UC tract was variable in length among sequenced clones, on average 4 (8 clones with 1 U insertion to 6 U deletions) and 10 (8 clones with 3-23 U deletions) nucleotides shorter than the original polyU/UC for F776S/P1100L/N1931S and F776S/P1100L/N1931T mutants, respectively. In addition, genome sequence analysis of first passage J6_LSGFΔ33U, J6_LSGVmΔ33U and J6_LSGFVmΔ33U (transfection in FIG. 2B) revealed that the engineered mutations were maintained; no additional mutations were found in J6_LSGVmΔ33U and J6_LSGFVmΔ33U, while J6_LSGFΔ33U had non-coding changes T4804C/T (NS3) and G7438G/A (NS5A). ‡, in a separate transfection experiment, first passage J6_LSGΔ33U (103.8 FFU/mL) acquired mutations T2667C/t (aa F776S), T2876T/G (F846V), A3548A/G (T1070A), A6132A/g/c (N1931S/T). a, this virus was named "J6cc" (J6 cell culture derived).

Figure 7:
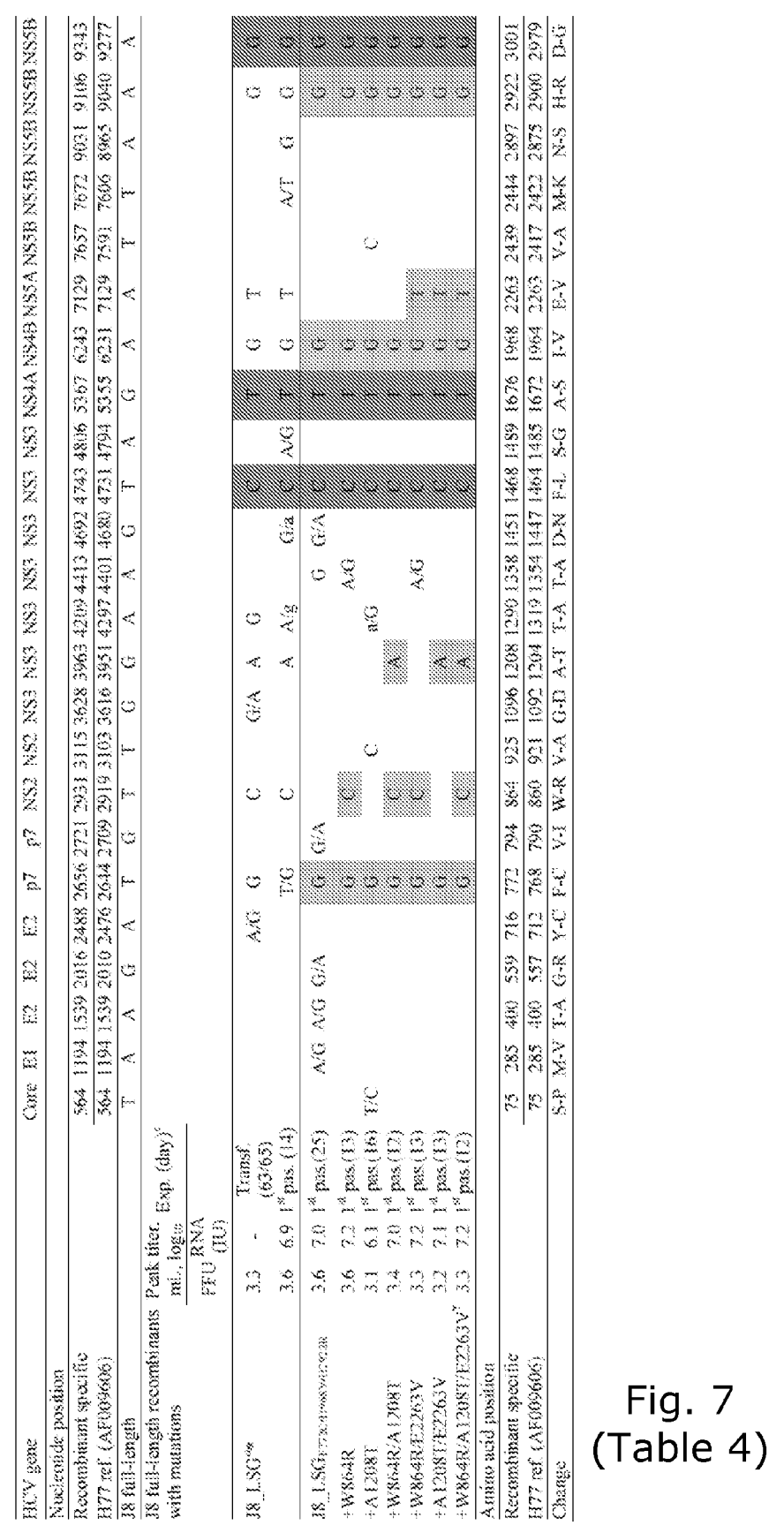

FIG. 7 (Table 4) shows analyses of recovered J8 full-length viruses. For each passaged J8 virus a representative peak infectivity titer (FFU/ml) with associated HCV RNA titer (IU/ml) is shown. Viruses of tranfection- and passage-derived J8_LSGa (J8 with F1468L/A1676S/D3001G, one of two transfections) and first passage J8_LSG with additional mutations were sequenced for ORF. Nucleotide and amino acid positions of the specific recombinant with coding mutations are listed; non-coding mutations are shown in Table S4. Shading indicates the engineered mutations: J6-derived mutations are shown with dark shading, J8-drived mutations with light shading. See Table 1 legend for details on annotations on nucleotides. ●, No amino acid change. c, viruses from indicated experiment was sequenced. *, the 5'UTR was determined, the 5'-terminal G was changed to A, consistent with our previous observations in JFH1-based systems. The 3'UTR of third passage viruses was determined; no consensus changes were observed in variable and 3'-X regions, however, the polyU/UC tract had 4-23 U (averagely 14 U) deletions among four sequenced clones. Second passage J8_LSGa sequence is shown in Table S4. -, RNA titer was not determined. t, this virus was named "J8cc" (J8 cell culture derived); in another experiment, no mutation was found. In addition, sequence analysis of transfection- and first passage-derived J8_LSGb showed that this virus also acquired mutations T2655T/G (aa F772V), A6243A/G (11968V) and A9106G (H2922R), representing three of the six coding mutations found in J8_LSGa transfection and first passage viruses.

FIG. 8 (Table S1) shows ORF sequence analysis of the J6/JFH1 recombinants with J6 NS5A-to-NS5B finger, palm and partial thumb domains. For the indicated recombinants, supernatants derived from transfection cultures (FIG. 1A) were used to infect naïve Huh7.5 cells. Supernatants collected at peak infection (≥80% infected cells) were subjected to RNA extraction for HCV ORF sequence analysis. Nucleotide and amino acid positions of the specific recombinants with mutations are listed; the corresponding position of the H77 reference sequence (AF009606) is given. Two capital letters separated by a slash indicate a nucleotide quasispecies (50/50). ●, No amino acid change.

FIG. 9 (Table S2) shows sequence analysis of first passage J6(JFH1_5BthuX) with mutations in p7, NS3 and NS4A.

Transfection-derived viable J6(JFH1_5BthuX) viruses with mutations (FIG. 1B) were passaged to naïve Huh7.5 cells, and supernatant collected at peak infection (≥80% cells infected) was subjected to RNA extraction and RT-PCR for HCV ORF sequence analysis. See Table S1 legend for details on annotations on nucleotides. Two capital letters separated by a slash indicates a nucleotide quasispecies (50/50), while a capital letter separated from a lowercase letter indicates dominant/minor nucleotides. Shading indicates the engineered mutations. ●, No amino acid change. *, the sequence of the 5'UTR of recovered viruses were determined by 5'RACE procedure using HCV RNA extracted from infection supernatant, the G added immediately before the 5'-terminal nucleotide A for enhancing in vitro transcription was deleted, consistent with our previous observations in JFH1-based HCV culture systems; no changes were observed in the 5'UTR. #, the 3'UTR of recovered virus was determined by 5'RACE procedure using HCV negative strand RNA extracted from infected cells, no consensus changes were observed in the variable and 3'-X regions; the length of the polyU/UC tract varied among clones analyzed; on average, F776S/A1676S mutant had 5 U (7 clones with 5 U insertions to 16 U deletions) deletions and F1468L/A1676S mutants showed 2 U (8 clones with 12 U insertions to 8 U deletions) insertions.

FIG. 10 (Table S3) shows sequence analysis of the ORF of J6 recombinants with minimal sequence form JFH1 NS5B thumb domain.

Transfection-derived viable J6 recombinants (FIG. 1D) were passaged to naïve Huh7.5 cells, and supernatant collected at peak infection was subjected to HCV ORF sequence analysis. See Table S1 and S2 legend for details on annotations on nucleotides. Shading indicates the engineered mutations. ●, no amino acid change. *, three U were deleted in 3'UTR polyU/UC tract of the final plasmid construct. #, fifteen U were deleted in the 3'UTR polyU/UC tract of the final plasmid construct; this deletion may not be a disadvantage for virus spread (FIG. 1D), as the recovered virus further deleted the polyU/UC tract (below). The 3'UTR of recovered virus was determined by 5'RACE procedure using HCV negative strand RNA extracted from infected cells, no consensus changes were observed in variable and 3'-X regions; the length of the polyU/UC tract among the sequenced clones varied, but was shorter than that in the original construct, on average 43 (6 clones with 28-79 U deletions), 73 (8 clones with 40-79 U delestions) and 37 (6 clones with 15-70 U deletions) U were deleted for mutants with JFH1 thumb aa372-591, 465-591 and 372-554, respectively.

Figure 11:
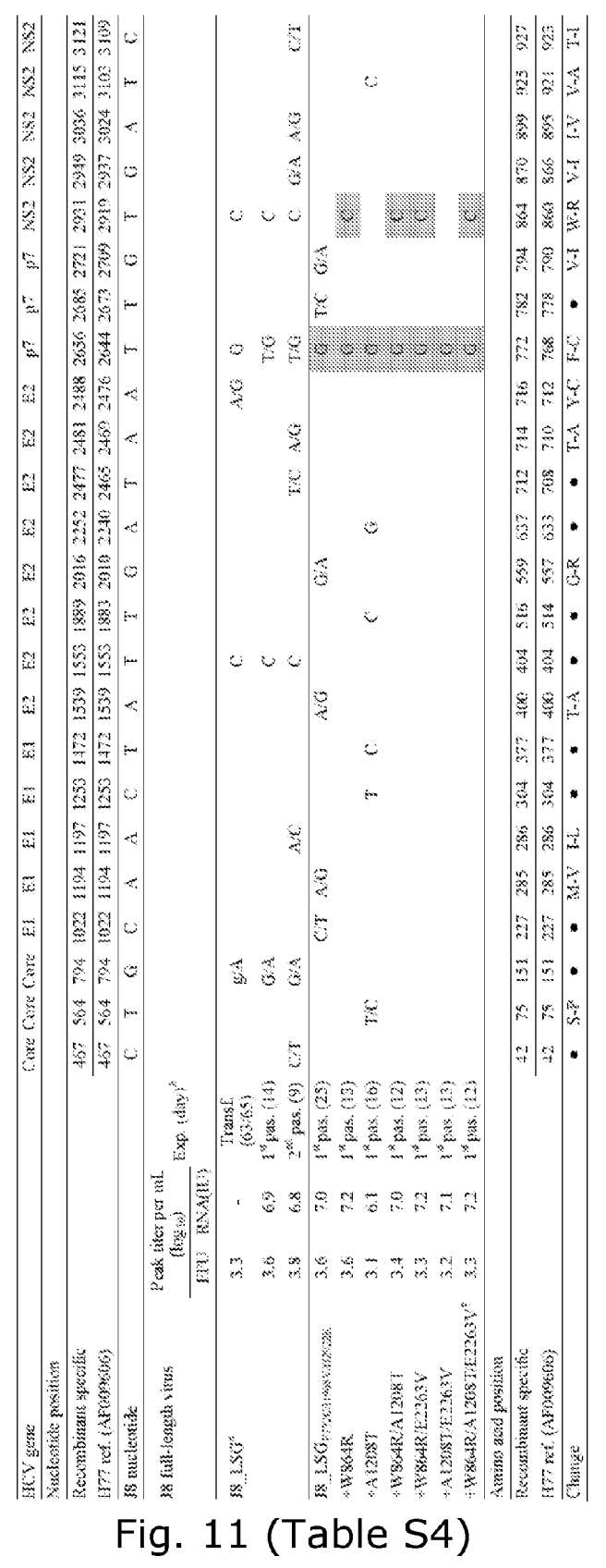
Figure 11:
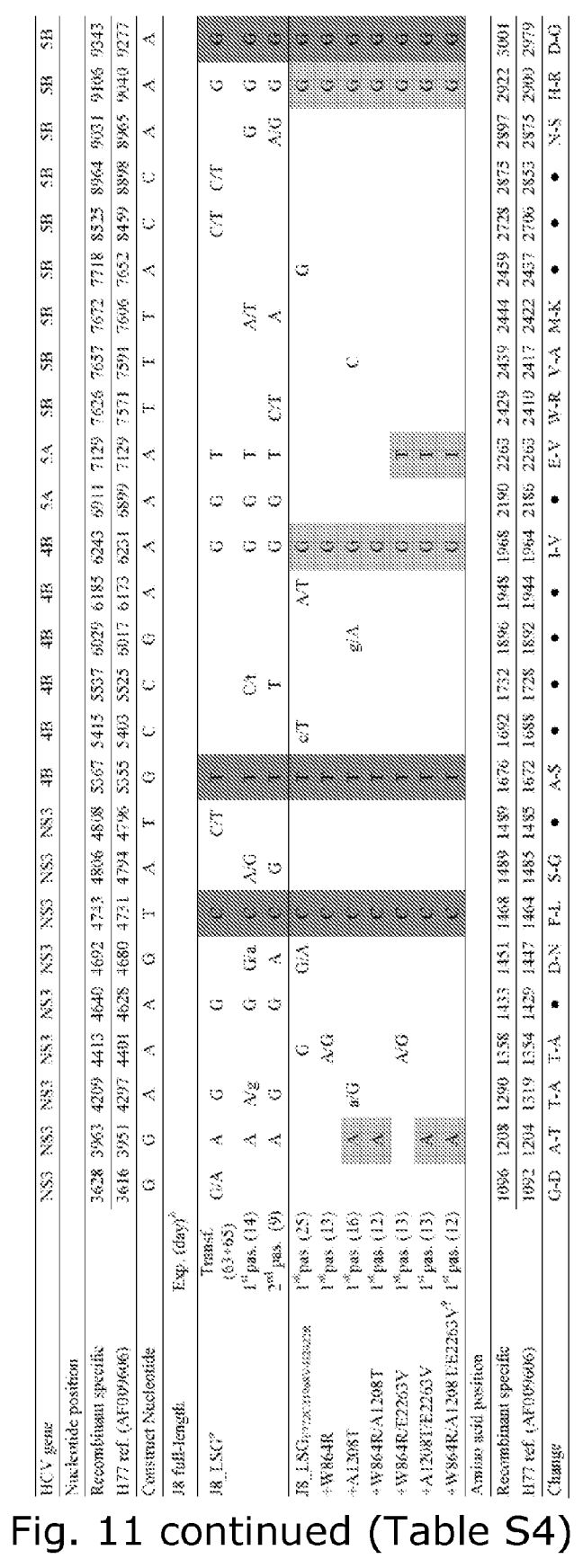

FIG. 11 (Table S4) shows HCV infectivity and RNA titers and genome sequence analysis of the J8 full-length viruses.

Transfection-derived J8_LSGa virus (J8 with F1468L/A16765/D3001G, from one of two experiments) and the J8_LSG with additional mutations were passaged to naïve Huh7.5 cells, supernatant collected at peak infection was subjected to ORF sequence analysis. Nucleotide and amino acid positions of the specific recombinant with mutations are listed (coding mutations only are shown in Table 4). See Table S1 and S2 legend for details on annotations on nucleotides. Shading indicates the engineered mutations: J6-derived mutations are shown with dark shading, J8-drived mutations with light shading. ●, No amino acid change. b, virus from the indicated experiment and day were sequenced. -, RNA titer was not determined. †, in another experiment, no mutation was found.

Figure 12:
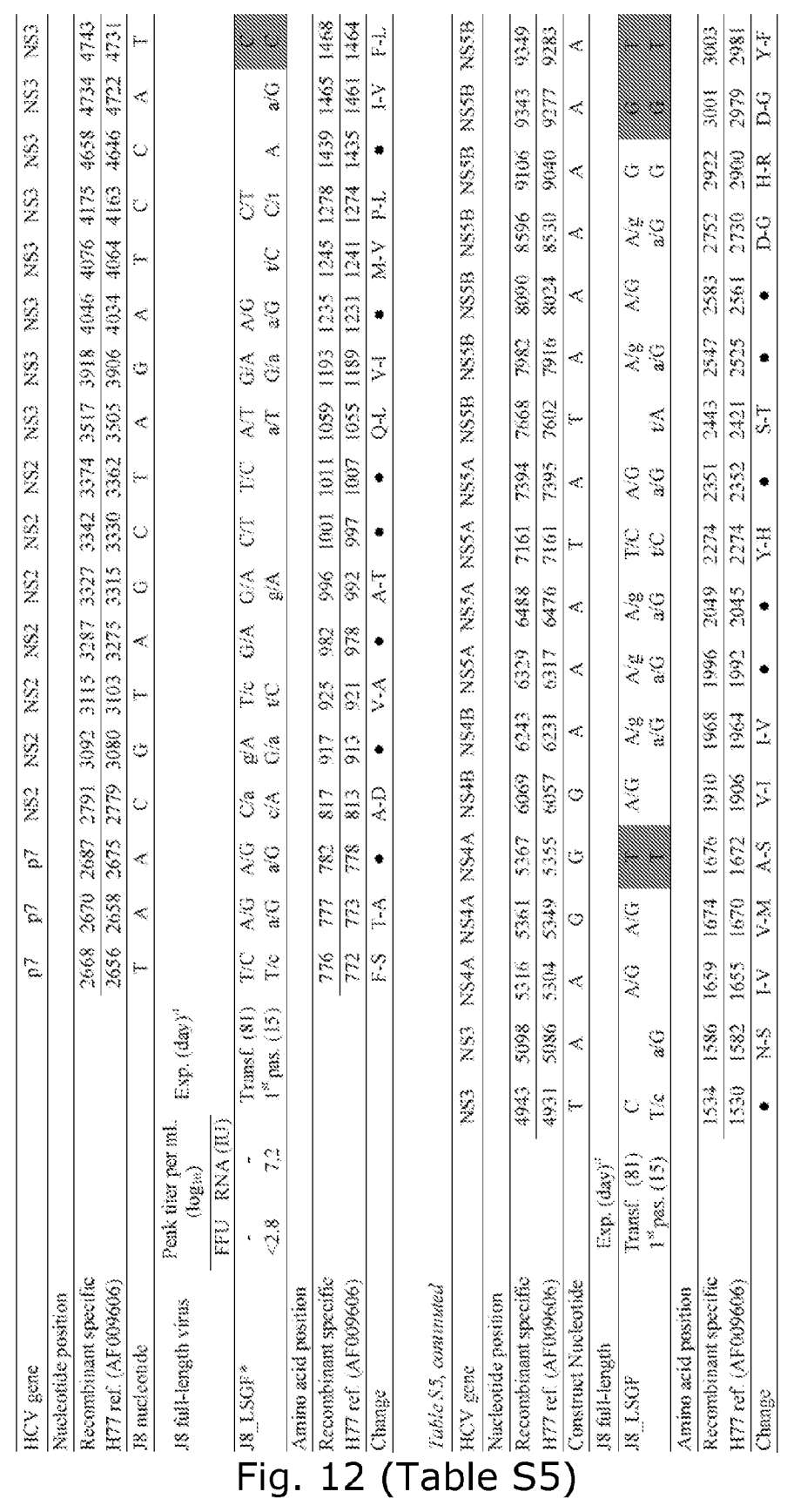

FIG. 12 (Table S5) shows sequence analysis of the J8_LSGF.

Transfection-derived J8_LSGF (J8 with F1468L/A1676S/D3001G/Y3003F) was passaged to naïve Huh7.5 cells, supernatant collected at peak infection was subjected to ORF sequence analysis. See Table S1 and S2 legend for details on annotations on nucleotides. Shading indicates the engineered mutations. ●, No amino acid change. *, the 5'UTR was determined by 5'RACE using RNA extract from culture supernatant of first passage virus, 5'-terminal G was changed to A, consistent with our previous observation for G to A change at 5'-terminus. The 3'UTR of third passage viruses was determined by 5'RACE using HCV negative strand RNA extracted from infected cells, no consensus changes were observed in variable and 3'-X regions, however, poly(U) tracts of different length were observed among sequenced clones. a, virus from the indicated experiment and day were sequenced. -, RNA titer was not determined.

FIG. 13 (Table S6) shows primers for sequence analysis of ORF and 3'UTR of 36 and J8 full-length viruses.

*, 3'UTR sequence was determined by 5'RACE using HCV negative strand RNA extracted from infected cells, the reverse primers for first and second PCR were from 5'RACE System for Rapid Amplication of cDNA ends, version 2.0 (Invitrogen).

Figure 14:
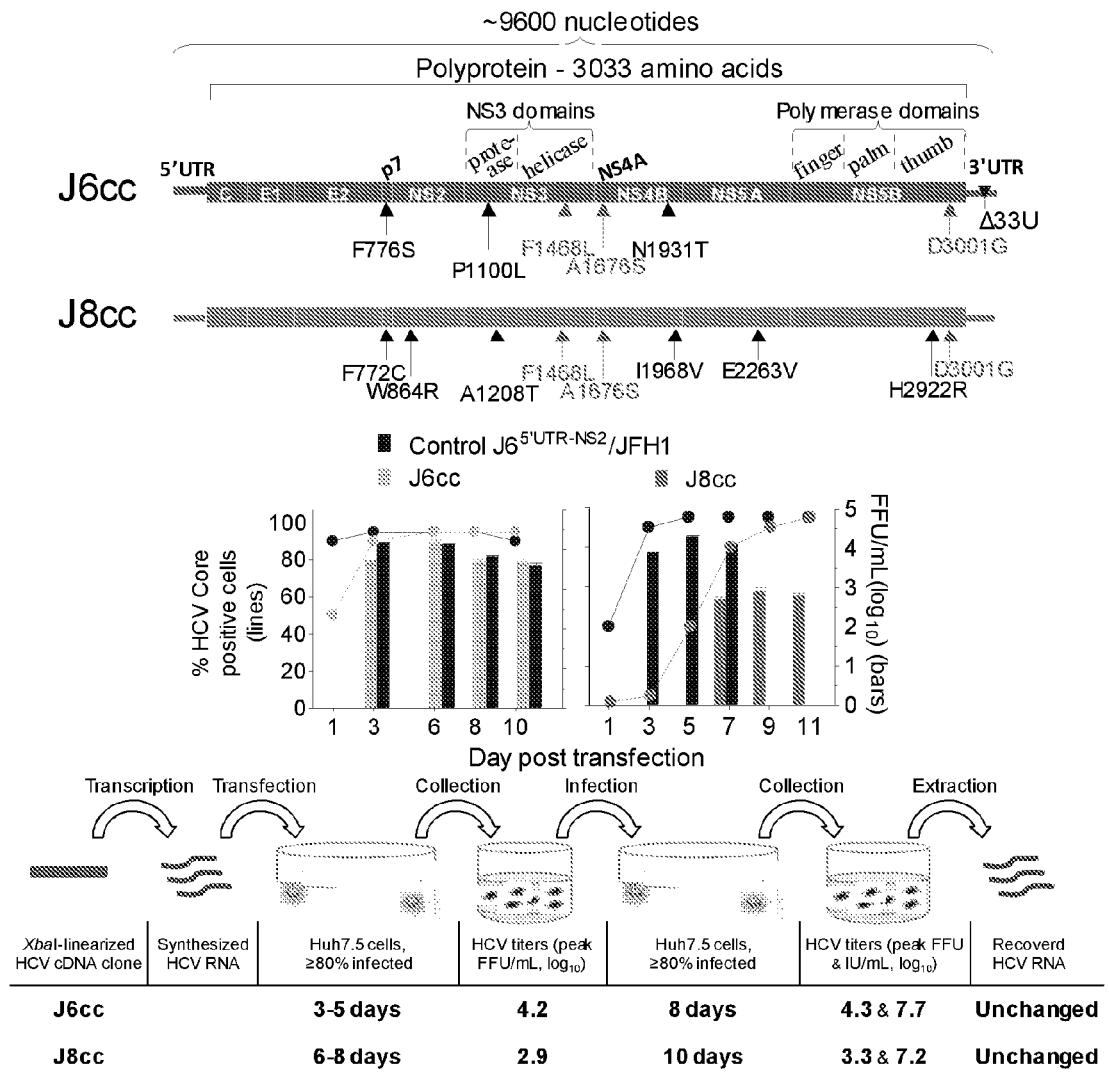

FIG. 14 shows efficient full-length HCV genotype 2a (J6cc) and 2b (J8cc) infectious culture systems.

Schematic diagrams illustrate HCV J6cc and J8cc genomes with cell culture adaptive mutations indicated. Functional domains in the NS3 (protease and helicase) and NS5B (finger, palm and thumb) proteins are indicated. Letterings highlight three 36-derived key mutations (F1468L/A1676S/D3001G, abbreviated LSG) that enabled 36 and 38 full-length genomes to replicate and to grow in Huh7.5 cells.

HCV cDNA clones cut with a restriction enzyme (XbaI) were transcribed into RNA transcripts, which were chemically transfected into Huh7.5 cells. The percentage of HCV positive cells was scored (left y-axis), and the transfected cells released infectious virus particles into the culture fluid, which could infect other cells. When ≥80% of cells were infected, culture fluid was collected, the number of infectious virus particles per milliliter of the fluid was determined by a focus-forming units assay (FFU/mL) (right y-axis). The collected culture fluid was used to infect naïve Huh7.5 cells (passage), the culture fluid was collected, and HCV FFU and RNA titers were determined, the latter as international units (IU)/mL. The entire genome sequence of recovered viral RNA was analyzed. No sequence changes were found in the recovered J6cc and J8cc RNA.

FIG. 15 shows development of HCV genotype is (strain TN) full-length infectious culture system.

RNA transcripts of HCV genomes with indicated structure and mutations (genome illustrations) were transfected into Huh7.5 cells (graphs), HCV Core and/or NS5A antigens were detected by immunostaining, and percentage of positive cells was estimated (left y-axis; shown as line plots). HCV infectivity titers in supernatant at peak of infection (≥80% HCV positive culture cells) were determined by FFU assay (mean of triplicate infections±SEM, right y-axis; shown as bar graphs). Duplicate experiments are shown as "exp. 1" and "exp. 2". J65'UTR-NS2/JFH1 was used as a positive control. (A) Previously identified F1464L/A1672S/D2979G [illustrated by black dots; referred to as LSG] initiated replication and adaptation of TN(JFH1_5BX) in Huh7.5 cells (graph). Mutations A1226G and Q1773H (bright dots) were identified in first passage viruses (FIGS. 16 and 17) and were able to adapt the TN(JFH1_5BX)_LSG for efficient growth. TN(JFH1_5BX) without mutations remained HCV antigen-negative 22 days after transfection. Data were not necessarily from one experiment; representative positive control is shown. (B) Combination of LSGF [LSG and Y2981F; black dots] and TN-derived mutations A1226G or A1226G/Q1773H (bright dots) permitted the TN full-length genome to replicate and produce infectious HCV in culture supernatant (graph, left panel). Additional identified mutations N1927S/T and/or F29945 (bright dots) further improved the viability of TN_LSGF/A1226G (middle panel) and TN_LSGF/A1226G/Q1773H (middle and right panels). TN full-length viruses TN_LSGF/A1226G/Q1773H/N1927S/F2994S or TN_LSGF/A1226G/Q1773H/N1927T/F2994S (right panel) produced peak supernatant infectivity titers of 4.6-4.9 log 10 FFU/ml in duplicate experiments, similar to positive control J65'UTR-NS2/JFH1 (4.7-4.9 log 10 FFU/ml).

FIG. 16 shows sequence analysis of the complete ORF of TN(JFH1_5BX) chimeric viruses, and of TN full-length viruses.

Figure 17:
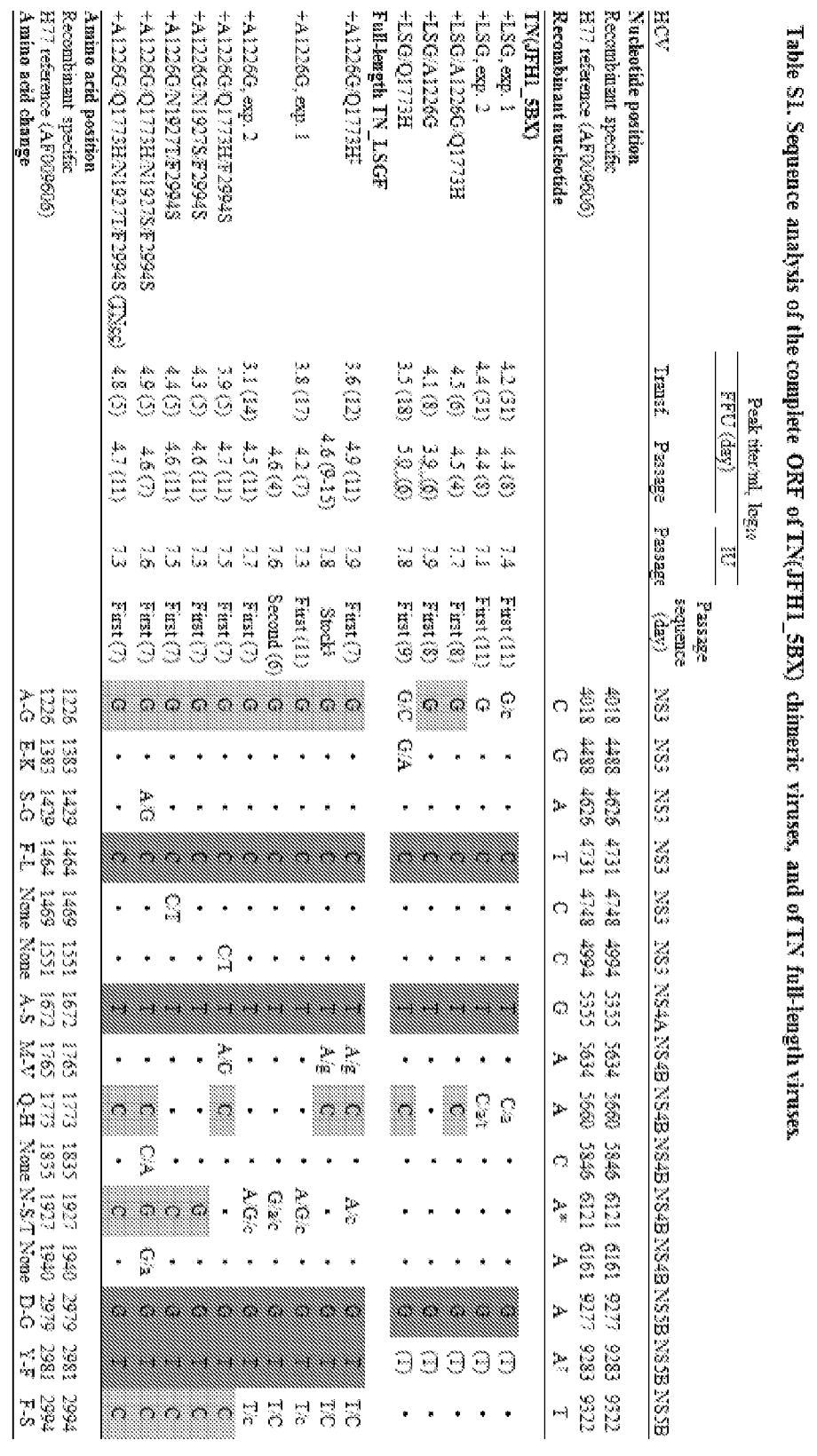

One milliliter of culture supernatant from TN(JFH1_5BX) and TN full-length transfections were passaged to naïve Huh7.5 cells (~4×10$^5$ cells), and culture supernatant collected at peak of infection (≥80% cells infected) was subjected to ORF sequence analysis. Nucleotide and amino acid positions of the specific recombinant with mutations are listed; the corresponding position of H77 reference sequence (AF009606) is given. Shadings indicate the engineered mutations; J6-drived mutations LSGF [LSG, F1464L/A1672S/D2979G; F, Y2981F] are in dark shading, TN-derived mutations are in light shading. Two capital letters separated by a slash indicates a nucleotide quasispecies (50/50) in sequencing reads, while a capital letter separated from a lowercase letter indicates a dominant/minor ratio. Only coding changes found in at least two viruses are shown; remaining changes are shown in FIG. 17 (table S1). Chimeric viruses TN(JFH1_5BX)_LSG/A1226G/Q1773H and TN(JFH1_5BX)_LSG/A1226G, and TN full-length viruses TN_LSGF/A1226G/N1927S/F2994S and TNcc have neither coding nor non-coding changes (FIG. 17, table S1). Dots indicate identity with original sequence. Viral infectivity titers were determined for at least three consecutive time points at and after peak of infection (≥80% cells infected), and representative peak infectivity titers (FFU/ml) are shown; RNA titers were between 7.1-7.9 log 10 IU/ml. *, A-to-G and A-to-C nucleotide changes correspond to amino acid changes N-to-S and N-to-T, respectively. t, TN(JFH1_5BX) recombinants originally have T at this position; indicated as "(T)". ‡, second, third, and fourth passage viruses showed supernatant HCV infectivity titers of $10^{5.1}$, $10^{5.5}$, and $10^{5.4}$ FFU/ml, respectively; the amino acid substitution F2994S was complete in the fourth passage virus—the original amino acid was not present. §, second passage virus had a peak titer of 4.6 log 10 IU/ml (FIG. 17). †, a virus stock pool made from first passage supernatants collected at days 9, 11, 13, and 15 was sequenced and used for antiviral treatment (FIG. 18).

FIG. 17 shows sequence analysis of the complete ORF of TN(JFH1_5BX) chimeric viruses, and of TN full-length viruses.

One milliliter of culture supernatant from TN(JFH1_5BX) and TN full-length transfections were passaged to naïve Huh7.5 cells (~4×$10^5$ cells), and culture supernatant collected at peak of infection (≥80% cells infected) was subjected to ORF sequence analysis. Primers used for RT-PCR were previously described (1-5). Nucleotide and amino acid positions of the specific recombinant with mutations are listed; the corresponding position of H77 reference sequence (AF009606) is given. Shadings indicate the engineered mutations; J6-drived mutations LSGF [LSG, F1464L/A1672S/D2979G; F, Y2981F] are in dark shading, TN-derived mutations are in light shading. Two capital letters separated by a slash indicates a nucleotide quasispecies (50/50) in sequencing reads, while a capital letter separated from a lowercase letter indicates a dominant/minor ratio. Dots indicate identity with original sequence. Viral infectivity titers were determined for at least three consecutive time points at and after peak of infection (≥80% cells infected), and representative peak infectivity titers (FFU/ml) are shown. RNA titers (IU/ml) of passage viruses with peak FFU titers were shown.

*, A-to-G and A-to-C nucleotide changes correspond to amino acid changes N-to-S and N-to-T, respectively.

†, TN(JFH1_5BX) recombinants originally have T at this position; indicated as "(T)".

‡, second, third, and fourth passage viruses showed supernatant HCV infectivity titers of $10^{5.1}$, $10^{5.5}$, and $10^{5.4}$ FFU/ml, respectively; the amino acid substitution F2994S was complete in the fourth passage virus—the original amino acid was not present.

§, a virus stock pool made from first passage supernatants collected at days 9, 11, 13, and 15 was sequenced and used for antiviral treatment (FIG. 18).

FIG. 18 shows dose-dependent efficacy of NS3/NS4A protease-, NS5A-, and NS5B polymerase-inhibitors and interferon-α2b against TN full-length virus. Naïve Huh7.5 cells were infected with first passage virus stock of TN full-length recombinant TN_LSGF/A1226G/Q1773H; the ORF sequence of this virus stock is shown in FIGS. 16 and 17. A J6/JFH1 virus stock was treated in parallel. Antivirals were administered 24 hours post infection at the indicated doses; interferon-α2b was also administered 48 hours post infection. The number of HCV positive cells per well was determined 72 hours post infection. (A) Dose response curves for treatments with lead compound protease inhibitors telaprevir (VX-950), boceprevir (SCH503034), and simeprevir (TMC435), NS5A inhibitor daclatasvir (BMS-790052), and NS5B inhibitor PSI-7977, as well as interferon-α2b. Values are means of triplicate determinations with SEM. (B) Median effective concentrations (EC50) of the used inhibitors against the indicated viruses. Values for EC50 and 95% confidence interval are shown.

The present invention will now be described in more detail in the following.

DETAILED DESCRIPTION OF THE INVENTION

The present invention advantageously provides hepatitis C virus (HCV) nucleotide sequences capable of replication, expression of functional HCV proteins, and infection in vivo and in vitro for development of antiviral therapeutics and diagnostics.

Nucleic Acid Molecules (cDNA Clones and RNA Transcripts)

The genomes of the different HCV genotypes have been standardized in a numbering system for HCV nucleotides, proteins and epitopes.

This work was done in an expert meeting and published in Kuiken et al., Hepatology, November 2006, page 1355-61.

This numbering system allows comparison of genes across genotypes with consistency and with an unambiguous method for referring to amino acid substitutions for specific positions in genes encoded by the HCV genome.

The numbering used in the present application uses this numbering system and with reference to the H77 reference sequence with GenBank accession number AF009606 used in Kuiken et al.

Thus, when no other statement is made will a specific number of a specific genotype refer to the H77 reference sequence with GenBank accession number AF009606.

In a broad aspect, the present invention is directed to an isolated nucleic acid molecule which encodes a human hepatitis C virus, wherein said molecule is capable of expressing said virus when transfected into cells, is capable of infectivity in vivo, comprises at least one adaptive mutation in the amino acid sequence of NS3, which is F1464L, comprises at least one adaptive mutation in the amino acid sequence of NS4A which is A16725, and comprises at least one adaptive mutation in the amino acid sequence of NS5B which is D2979G according to the H77 reference sequence with GenBank accession number AF009606.

The adaptive mutations as shown above means that in the case of F1464L is phenylalanine at amino acid position 1464 changed to Leucine.

The original amino acids F1464, A1672, and D2979 (H77 reference numbers) at LSG positions are highly conserved across all HCV genotypes.

In one embodiment the present invention comprises the nucleic acid molecule with a shortened 3' UTR region.

A shortened 3' UTR region refers to any 3' UTR region wherein one or more nucleotides have been deleted. The present inventors have exemplified such shortened 3'UTR region by a 33 U deletion in the 3'UTR (Δ33U) (see example 1).

In another embodiment of the present invention the human hepatitis C virus is of a genotype selected from the group consisting of 1a, 1b, 2a, 2b, 2c, 3a, 4a, 4d, 5a, 6a and 7a.

The terms "isolate" and "strain" are used herein interchangeably.

In a preferred embodiment of the present invention the human hepatitis C virus is a strain of genotype 1a.

In a preferred embodiment of the present invention the human hepatitis C virus is a strain of genotype 2a or 2b.

In another preferred embodiment of the present invention the human hepatitis C virus is a strain of genotype 2a.

In another preferred embodiment of the present invention the human hepatitis C virus is a strain of genotype 2b.

In another preferred embodiment of the present invention the hepatitis C virus is of genotype 2a and is isolate J6_LSGΔ33U (SEQ ID NO: 25).

In another preferred embodiment of the present invention the hepatitis C virus is of genotype 2b and is isolate J8_LSG (SEQ ID NO: 41).

In another preferred embodiment of the present invention the hepatitis C virus is of genotype 1a and is TN(JFH1_5BX)_LSG (SEQ ID NO:134).

The hepatitis C virus can in some embodiments of the present invention comprise further adaptive mutations.

Thus, in one embodiment the present invention comprises the hepatitis C virus of genotype 2a and at least one further adaptive mutation selected from the group consisting of F776S in p7, P1100L in NS3, N1931S in NS4B, N1931T in NS4B and Y3003F in NS5B corresponding to F772S in p7, P1096L in NS3, N1927S in NS4B, N1927T in NS4B and Y2981F in NS5B according to the H77 reference sequence with GenBank accession number AF009606.

In another embodiment the present invention comprises the hepatitis C virus of genotype 2b and at least one further adaptive mutation selected from the group consisting of F772C in p7, W864R in NS2, A1208T in NS3, I1968V in NS4B, E2263V in NS5A, and H2922R in NS5B corresponding to F768C in p7, W860R in NS2, A1204T in NS3, I1964V in NS4B, E2263V in NS5A, and H2900R in NS5B according to the H77 reference sequence with GenBank accession number AF009606.

In another embodiment the present invention comprises the hepatitis C virus of genotype 1a and at least one further adaptive mutation selected from the group consisting of A1226G in NS3, Q1773H in NS4B, N1927S in NS4B, N1927T in NS4B and F2994S in NS5B according to the H77 reference sequence with GenBank accession number AF009606.

In one embodiment the present invention comprises the hepatitis C virus and at least six further adaptive mutations, such as five, such as four, such as three, such as two.

In a preferred embodiment of the present invention the hepatitis C virus is of genotype 2a and is isolate J6cc (SEQ ID NO: 39) corresponding to GenBank accession number JQ745650.

The adaptive LSG mutations of isolate J6cc are F1468L/A1676S/D3001G corresponding to F1464L/A1672S/D2979G according to the H77 reference sequence with GenBank accession number AF009606. The work has been published as Li et al., Proc Natl Acad Sci USA. 2012 May 1; 109(18):E1101-10. Also see Author Summary in Proc Natl Acad Sci USA on page 6806 (volume 109, number 18).

In another preferred embodiment of the present invention the hepatitis C virus is of genotype 2b and is isolate J8cc (SEQ ID NO: 56) corresponding to GenBank accession number JQ745652.

The adaptive LSG mutations of isolate J8cc are F1468L/A1676S/D3001G corresponding to F1464L/A1672S/D2979G according to the H77 reference sequence with GenBank accession number AF009606. The work has been published as Li et al., Proc Natl Acad Sci USA. 2012 May 1; 109(18):E1101-10. Also see Author Summary in Proc Natl Acad Sci USA on page 6806 (volume 109, number 18).

In another preferred embodiment of the present invention the hepatitis C virus is of genotype 1a and is isolate TNcc (SEQ ID NO: 145) corresponding to GenBank accession number JX993348.

The adaptive LSG mutations of isolate TNcc are F1464L/A1672S/D2979G according and they correspond to the H77 reference sequence with GenBank accession number AF009606. The work has been published as Li et al., Proc Natl Acad Sci USA. 2012 Nov. 27; 109(48):19757-62.

The present inventors have identified a wide variety of recombinants that generated different virus viability.

These recombinants are described in the examples of the present application and are disclosed in the sequence listing as SEQ ID NO: 1-66 and 133-145 (nucleic acid sequences) and SEQ ID NO: 67-132 and 146-158 (amino acid sequences).

In an embodiment of the present invention are these sequences isolated nucleic acid sequences and amino acid sequence, respectively.

The present inventors have also identified a full-length consensus clone of genotype 2b, J8CF (SEQ ID NO: 40).

Thus, one embodiment of the present invention relates to an isolated nucleic acid molecule which encodes a human hepatitis C virus wherein the hepatitis C virus is derived from genotype 2b, isolate J8 and has a nucleic acid sequence with 90% sequence identity to SEQ ID NO: 40.

In a preferred embodiment of the present invention the isolated nucleic acid molecule is isolate J8CF (SEQ ID NO: 40).

As commonly defined "identity" is here defined as sequence identity between genes or proteins at the nucleotide or amino acid level, respectively.

Thus, in the present context "sequence identity" is a measure of identity between proteins at the amino acid level and a measure of identity between nucleic acids at nucleotide level. The protein sequence identity may be determined by comparing the amino acid sequence in a given position in each sequence when the sequences are aligned. Similarly, the nucleic acid sequence identity may be determined by comparing the nucleotide sequence in a given position in each sequence when the sequences are aligned.

To determine the percent identity of two amino acid sequences or of two nucleic acids, the sequences are aligned for optimal comparison purposes (e.g., gaps may be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences (i.e., % identity=# of identical positions/total # of positions (e.g., overlapping positions)×100).

In one embodiment the two sequences are the same length.

In another embodiment the two sequences are of different length and gaps are seen as different positions.

One may manually align the sequences and count the number of identical amino acids. Alternatively, alignment of two sequences for the determination of percent identity may be accomplished using a mathematical algorithm. Such an algorithm is incorporated into the NBLAST and XBLAST programs of (Altschul et al. 1990). BLAST nucleotide searches may be performed with the NBLAST program, score=100, wordlength=12, to obtain nucleotide sequences homologous to a nucleic acid molecules of the invention. BLAST protein searches may be performed with the XBLAST program, score=50, wordlength=3 to obtain amino acid sequences homologous to a protein molecule of the invention. To obtain gapped alignments for comparison purposes, Gapped BLAST may be utilised. Alternatively, PSI-Blast may be used to perform an iterated search which detects distant relationships between molecules. When utilising the NBLAST, XBLAST, and Gapped BLAST programs, the default parameters of the respective programs may be used. See http://www.ncbi.nlm.nih.gov. Alternatively, sequence identity may be calculated after the sequences have been aligned e.g. by the BLAST program in the EMBL database (www.ncbi.nlm.gov/cgi-bin/BLAST). Generally, the default settings with respect to e.g. "scoring matrix" and "gap penalty" may be used for alignment. In the context of the present invention, the BLASTN and PSI BLAST default settings may be advantageous.

The percent identity between two sequences may be determined using techniques similar to those described above, with or without allowing gaps. In calculating percent identity, only exact matches are counted.

An embodiment of the present invention thus relates to sequences of the present invention that has some degree of sequence variation.

One embodiment relates to J6cc (SEQ ID NO: 39) in which the nucleic acid molecule comprises the nucleic acid sequence with a sequence identity of at least 80% to that of SEQ ID NO: 39.

In another embodiment, the nucleic acid comprises a sequence sharing at least 85% identity with that set forth in SEQ ID NO: 39, such as 90% identity, 91% identity, 92% identity, 93% identity, 94% identity, 95% identity, 96% identity, 97% identity, 98% identity, or 99% identity.

Another embodiment relates to J8cc (SEQ ID NO: 56) in which the nucleic acid molecule comprises the nucleic acid sequence with a sequence identity of at least 80% to that of SEQ ID NO: 56.

In another embodiment, the nucleic acid comprises a sequence sharing at least 85% identity with that set forth in SEQ ID NO: 56, such as 90% identity, 91% identity, 92% identity, 93% identity, 94% identity, 95% identity, 96% identity, 97% identity, 98% identity, or 99% identity.

Yet another embodiment relates to J8_LSG (SEQ ID NO: 41) in which the nucleic acid molecule comprises the nucleic acid sequence with a sequence identity of at least 80% to that of SEQ ID NO: 41.

In another embodiment, the nucleic acid comprises a sequence sharing at least 85% identity with that set forth in SEQ ID NO: 41, such as 90% identity, 91% identity, 92% identity, 93% identity, 94% identity, 95% identity, 96% identity, 97% identity, 98% identity, or 99% identity.

A further embodiment relates to J6_LSGΔ33U (SEQ ID NO: 25) in which the nucleic acid molecule comprises the nucleic acid sequence with a sequence identity of at least 80% to that of SEQ ID NO 25.

In another embodiment, the nucleic acid comprises a sequence sharing at least 85% identity with that set forth in SEQ ID NO: 25, such as 90% identity, 91% identity, 92% identity, 93% identity, 94% identity, 95% identity, 96% identity, 97% identity, 98% identity, or 99% identity.

Yet another embodiment relates to J8CF (SEQ ID NO:40) in which the nucleic acid molecule comprises the nucleic acid sequence with a sequence identity of at least 80% to that of SEQ ID NO: 40.

In another embodiment, the nucleic acid comprises a sequence sharing at least 85% identity with that set forth in SEQ ID NO: 40, such as 90% identity, 91% identity, 92% identity, 93% identity, 94% identity, 95% identity, 96% identity, 97% identity, 98% identity, or 99% identity.

Yet another embodiment relates to TNcc (SEQ ID NO:145) in which the nucleic acid molecule comprises the nucleic acid sequence with a sequence identity of at least 80% to that of SEQ ID NO: 145.

In another embodiment, the nucleic acid comprises a sequence sharing at least 85% identity with that set forth in SEQ ID NO: 145, such as 90% identity, 91% identity, 92% identity, 93% identity, 94% identity, 95% identity, 96% identity, 97% identity, 98% identity, or 99% identity.

Yet another embodiment relates to TN(JFH1_5BX)_LSG (SEQ ID NO:134) in which the nucleic acid molecule comprises the nucleic acid sequence with a sequence identity of at least 80% to that of SEQ ID NO: 134.

In another embodiment, the nucleic acid comprises a sequence sharing at least 85% identity with that set forth in SEQ ID NO: 134, such as 90% identity, 91% identity, 92% identity, 93% identity, 94% identity, 95% identity, 96% identity, 97% identity, 98% identity, or 99% identity.

It should be noted that while several of the sequences in the present application (SEQ ID NOs: 1-66 and 133-145) are DNA sequences, the present invention contemplates the corresponding RNA sequence, and DNA and RNA complementary sequences as well.

Thus, in cases where a DNA sequence is mentioned refers such DNA sequence also to the RNA equivalent i.e. with Ts exchanged with Us as well as their complimentary sequences.

In another embodiment, the HCV nucleic acid is a DNA that codes on expression or after in vitro transcription for a replication-competent HCV RNA genome, or is itself a replication-competent HCV RNA genome.

In one embodiment, the HCV nucleic acid of the invention has a full-length sequence as depicted in or corresponding to the sequences of the present invention.

Various modifications for example of the 5' and 3' UTR are also contemplated by the invention.

In another embodiment, the nucleic acid further comprises a reporter gene, which, in one embodiment, is a gene encoding neomycin phosphotransferase, Renilla luciferase, secreted alkaline phosphatase (SEAP), Gaussia luciferase or the green fluorescent protein.

Naturally, as noted above, the HCV nucleic acid sequence of the invention is selected from the group consisting of double stranded DNA, positive-sense cDNA, or negative-sense cDNA, or positive-sense RNA or negative-sense RNA or double stranded RNA.

Thus, where particular sequences of nucleic acids of the invention are set forth, both DNA and corresponding RNA are intended, including positive and negative strands thereof.

In a further embodiment, the nucleic acid sequences or the nucleic acid sequences with any mutation described in this document is obtained by any other means than what is described above.

Nucleic acid molecules according to the present invention may be inserted in a plasmid vector for translation of the corresponding HCV RNA. Thus, the HCV DNA may comprise a promoter 5' of the 5'-UTR on positive-sense DNA, whereby transcription of template DNA from the promoter produces replication-competent RNA. The promoter can be selected from the group consisting of a eukaryotic promoter, yeast promoter, plant promoter, bacterial promoter, or viral promoter.

Thus, in one embodiment the present invention provides a cassette vector for cloning viral genomes, comprising, inserted therein, the nucleic acid sequence according to the invention and having an active promoter upstream thereof.

Adaptive Mutations

Adapted mutants of a HCV-cDNA construct or HCV-RNA full-length genome with improved abilities to generate infectious viral particles in cell culture compared to the original HCV-cDNA construct or the original HCV-RNA full-length genome are characterized in that they are obtainable by a method in which the type and number of mutations in a cell culture adapted HCV-RNA genome are determined through sequence analysis and sequence comparison and these mutations are introduced into a HCV-cDNA construct, particularly a HCV-cDNA construct according to the present invention, or into an (isolated) HCV-RNA full-length genome, either by site-directed mutagenesis, or by exchange of DNA fragments containing the relevant mutations.

The present inventors here report adaptive mutations, which allow efficient formation and release of viral particles in cell culture, and thus the present invention relates to these adaptive mutations in the present use as well as use in other strains by changing equivalent positions of such genomes to the adapted nucleotide or amino acid described.

A group of preferred HCV-cDNA constructs, HCV-RNA full-length genomes with the ability to release viral particles in cell culture, which are consequently highly suitable for practical use, is characterized in that it contains one, several or all of the nucleic acid exchanges listed below and/or one or several or all of the following amino acid exchanges.

One embodiment of the present invention relates to adaptive mutations, wherein the adaptive mutation is a mutation that can be observed by clonal or direct sequencing of recovered replicating genomes of the sequences of the present invention.

Thus in a further embodiment, the present invention relates to nucleic acid molecules according to the present invention, wherein said molecule comprises one or more adaptive mutations in p7, NS2, NS3, NS4A, NS4B, NS5A or NS5B singly or in combination.

In the context of the present invention the term "adaptive mutation" is meant to cover mutations identified in passaged viruses that provide the original and any other HCV sequence the ability to grow efficiently in culture. Furthermore all introductions of mutations into the sequences described, whether or not yielding better growth abilities, and the introduction of these mutations into any HCV sequence should be considered.

Thus the described mutations enable the HCV-RNA genome (e.g. derived from a HCV-cDNA clone) to form viral particles in and release these from suitable cell lines. In addition some of the described mutations might change the function of the concerned proteins in favourable ways, which might be exploited in other experimental systems employing these proteins.

This also includes other HCV genomes with adaptive mutations, all of them, combinations of them or individual mutations that grow in culture.

It should be understood that any feature and/or aspect discussed above in connection with the mutations according to the invention apply by analogy to both single mutations and any combination of the mutations.

In another embodiment all the amino acid changes observed herein are provided by the present application. The skilled addressee can easily obtain the same amino acid change by mutating another base of the codon and hence all means of obtaining the given amino acid sequence is intended.

Titer

To determine the efficiency of the developed system, HCV RNA titers are determined in IU/ml (international units/ml) with Taq-Man Real-Time-PCR and infectious titers are determined with a 50% tissue culture infectious dose method. This titer shows the dilution of the examined viral stock, at which 50% of the replicate cell cultures used in the essay become infected and is given in TCID50/ml.

Alternatively the infectious titers are determined as FFU/ml (focus forming unites/ml); in such method, infectivity titers are determined by infection of cell culture replicates with serial dilutions of virus containing supernatants and, following immuno-stainings for HCV antigens, counting of HCV-antigen positive cell foci.

HCV RNA titers and infectivity titers can be determined extracellularly, in cell culture supernatant (given as IU and TCID50 or FFU per ml, respectively) or intracellularly, in lysates of pelleted cells (given as IU and TCID50 or FFU related to a the given cell number or culture plate wells, which was lysed).

One embodiment of the present invention relates to a nucleic acid molecule of the present invention, wherein said molecule is capable of generating a HCV RNA titer of $10^4$ IU/ml or above following transfection and/or subsequent viral passage, such as a titer of at least $10^5$ IU/mL, such as a titer of at least $10^6$ IU/mL, such as a titer of at least $10^7$ IU/mL, such as a titer of at least $10^8$ IU/mL, such as a titer of at least $10^{91}$ U/mL, such as a titer of at least $10^{10}$ IU/mL, such as a titer of at least $10^{11}$ IU/mL, or such as a titer of at least $10^{12}$ IU/mL.

In another embodiment, the present invention relates to a nucleic acid molecule according to the invention, wherein said molecule is capable of generating a HCV infectivity titer of at least $10^2$ TCID50/ml or above following transfection and/or subsequent viral passage, such as a titer of at least $10^3$ TCID50/ml, such as a titer of at least $10^4$ TCID50/ml, such as a titer of at least $10^5$ TCID50/ml, such as a titer of at least $10^6$ TCID50/ml, such as a titer of at least $10^7$ TCID50/ml, such as a titer of at least $10^8$ TCID50/ml, such as a titer of at least $10^9$ TCID50/ml or such as a titer of at least $10^{10}$ TCID50/ml.

It is of course evident to the skilled addressee that the titers described here are obtained using the assay described in this text. Any similar or equivalent titer determined by any method is thus evidently within the scope of the present invention.

Compositions

One embodiment of the present invention relates to a composition comprising a nucleic acid molecule according to the invention suspended in a suitable amount of a pharmaceutical acceptable diluent or excipient.

In another embodiment, this invention provides for compositions comprising an isolated nucleic acid, vector or cell of this invention, or an isolated nucleic acid obtained via the methods of this invention.

In one embodiment, the term "composition" refers to any such composition suitable for administration to a subject, and such compositions may comprise a pharmaceutically acceptable carrier or diluent, for any of the indications or modes of administration as described. The active materials in the compositions of this invention can be administered by any appropriate route, for example, orally, parenterally, intravenously, intradermally, subcutaneously, or topically, in liquid or solid form.

It is to be understood that any applicable drug delivery system may be used with the compositions and/or agents/vectors/cells/nucleic acids of this invention, for administration to a subject, and is to be considered as part of this invention.

The compositions of the invention can be administered as conventional HCV therapeutics. The compositions of the invention may include more than one active ingredient which interrupts or otherwise alters groove formation, or occupancy by RNA or other cellular host factors, in one embodiment, or replicase components, in another embodiment, or zinc incorporation, in another embodiment.

The precise formulations and modes of administration of the compositions of the invention will depend on the nature of the anti-HCV agent, the condition of the subject, and the judgment of the practitioner. Design of such administration and formulation is routine optimization generally carried out without difficulty by the practitioner.

It is to be understood that any of the methods of this invention, whereby a nucleic acid, vector or cell of this invention is used, may also employ a composition comprising the same as herein described, and is to be considered as part of this invention.

"Pharmaceutically acceptable" refers to molecular entities and compositions that are physiologically tolerable and do not typically produce an allergic or similar untoward reaction, such as gastric upset, dizziness and the like, when administered to a human. Preferably, as used herein, the term "pharmaceutically acceptable" means approved by a regulatory agency of the Federal or a state government or listed in the U.S. Pharmacopoeia or other generally recognized pharmacopoeia for use in animals, and more particularly in humans.

The term "excipient" refers to a diluent, adjuvant, carrier, or vehicle with which the compound is administered. Such pharmaceutical carriers can be sterile liquids, such as water and oils, including those of petroleum, animal, vegetable or synthetic origin, such as peanut oil, soybean oil, mineral oil, sesame oil and the like. Water or aqueous solution saline solutions and aqueous dextrose and glycerol solutions are preferably employed as carriers, particularly for injectable solutions. Suitable pharmaceutical carriers are described in "Remington's Pharmaceutical Sciences" by E. W. Martin.

The term "adjuvant" refers to a compound or mixture that enhances the immune response to an antigen. An adjuvant can serve as a tissue depot that slowly releases the antigen and also as a lymphoid system activator that non-specifically enhances the immune response. Often, a primary challenge with an antigen alone, in the absence of an adjuvant, will fail to elicit a humoral or cellular immune response.

Adjuvants include, but are not limited to, complete Freund's adjuvant, incomplete Freund's adjuvant, saponin, mineral gels such as aluminum hydroxide, surface active substances such as lysolecithin, pluronic polyols, polyanions, peptides, oil or hydrocarbon emulsions, keyhole limpet hemocyanins, dinitrophenol, and potentially useful human adjuvants such as BCG (bacille Calmette-Guerin) and *Corynebacterium parvum*.

Preferably, the adjuvant is pharmaceutically acceptable.

Thus relates one embodiment of the present invention to a composition comprising a nucleic acid molecule according to the present invention suspended in a suitable amount of a pharmaceutical acceptable diluent or excipient.

Cells

The nucleotides of the present invention may be used to provide a method for identifying additional cell lines that are permissive for infection with HCV, comprising contacting (e.g. transfecting) a cell line in tissue culture with an infectious amount of HCV RNA of the present invention, e.g., as produced from the plasmid clones, and detecting replication and formation and release of viral particles of HCV in cells of the cell line.

Naturally, the invention extends as well to a method for identifying an animal that is permissive for infection with HCV, comprising introducing an infectious amount of the HCV RNA, e.g., as produced by the plasmids, to the animal, and detecting replication and formation and release of viral particles of HCV in the animal. By providing infectious HCV, e.g. comprising a dominant selectable marker, the invention further provides a method for selecting for HCV with further adaptive mutations that permit higher levels of HCV replication in a permissive cell line or animal comprising contacting (e.g. transfecting) a cell line in culture, or introducing into an animal, an infectious amount of the HCV RNA, and detecting progressively increasing levels of HCV RNA and infectious HCV viral particles in the cell line or the animal.

In a specific embodiment, the adaptive mutation permits modification of HCV tropism. An immediate implication of this aspect of the invention is creation of new valid cell culture and animal models for HCV infection.

The permissive cell lines or animals that are identified using the nucleic acids of the invention are very useful, inter alia, for studying the natural history of HCV infection, isolating functional components of HCV, and for sensitive, fast diagnostic applications, in addition to producing authentic HCV virus or components thereof.

Because the HCV DNA, e.g., plasmid vectors, of the invention encode HCV components, expression of such vectors in a host cell line transfected, transformed, or transduced with the HCV DNA can be effected.

For example, a baculovirus or plant expression system can be used to express HCV virus particles or components thereof. Thus, a host cell line may be selected from the group consisting of a bacterial cell, a yeast cell, a plant cell, an insect cell, and a mammalian cell.

In one embodiment, the cell is a hepatocyte, or in another embodiment, the cell is the Huh-7 hepatoma cell line or a derived cell line such as Huh7.5, Huh7.5.1 cell line.

In one embodiment, the cell, or in another embodiment, cell systems of this invention comprise primary cultures or other, also non hepatic cell lines. "Primary cultures" refers, in one embodiment, to a culture of cells that is directly derived from cells or tissues from an individual, as well as cells derived by passage from these cells, or immortalized cells.

In one embodiment, "cell line" refers to a population of cells capable of continuous or prolonged growth and division in vitro. The term "cell lines" also includes immortalized cells. Often, cell lines are clonal populations derived from a single progenitor cell. Such cell lines are also termed "cell clones". It is further known in the art that spontaneous or induced changes can occur in karyotype during storage or transfer of such clonal populations. Therefore, cells derived from the cell clones referred to may not be precisely identical to the ancestral cells or cultures. According to the present invention, such cell clones may be capable of supporting replication of a vector, virus, viral particle, etc., of this invention, without a significant decrease in their growth properties, and are to be considered as part of this invention.

It is to be understood that any cell of any organism that is susceptible to infection by or propagation of an HCV construct, virus or viral particle of this invention is to be considered as part of this invention, and may be used in any method of this invention, such as for screening or other assays, as described herein.

Thus relates one embodiment of the present invention to a cell comprising the nucleic acid according to the present invention, the composition of present invention or the cassette vector of the present invention.

Another embodiment of the present invention relates to a method for producing a cell, which replicates human hepatitis C virus and produces a virus particle comprising introducing a nucleic acid molecule of the present invention into a cell.

In a preferred embodiment is the cell is a Huh7.5 cell.

Another embodiment of the present invention relates to a cell obtainable by the methods of the present invention.

Also, a method for in vitro producing a hepatitis C virus-infected cell comprising culturing the cell which produces virus particles of the present invention and infecting other cells with the produced virus particle in the culture.

Naturally, the invention extends to any cell obtainable by such methods, for example any in vitro cell line infected with HCV, wherein the HCV has a genomic RNA sequence as described herein such as a hepatitis C virus infected cell obtainable by any of the methods described.

In one embodiment, the cell line is a hepatocyte cell line such as Huh7 or derived cell lines e.g. Huh7.5 or Huh7.5.1.

In another embodiment the cell is Huh7.5.

In another embodiment the cell is any cell expressing the genes necessary for HCV infection and replication, such as but not limited to CD81, SR-BI, Claudin-1, -4, -6 or -9 and the low-density lipid receptor.

The invention further provides various methods for producing HCV virus particles, including by isolating HCV virus particles from the HCV-infected non-human animal of invention; culturing a cell line of the invention under conditions that permit HCV replication and virus particle formation; or culturing a host expression cell line transfected with HCV DNA under conditions that permit expression of HCV particle proteins; and isolating HCV particles or particle proteins from the cell culture. The present invention extends to an HCV virus particle comprising a replication-competent HCV genome RNA, or a replication-defective HCV genome RNA, corresponding to an HCV nucleic acid of the invention as well.

Virus Particle

The production of authentic virus proteins (antigens) may be used for the development and/or evaluation of diagnostics. The cell culture system according to the invention also allows the expression of HCV antigens in cell cultures. In principle these antigens can be used as the basis for diagnostic detection methods.

The production of HCV viruses and virus-like particles, in particular for the development or production of therapeutics and vaccines as well as for diagnostic purposes is an embodiment of the present invention. Especially cell culture adapted complete HCV genomes, which could be produced by using the cell culture system according to the invention, are able to replicate and form viral particles in cell culture with high efficiency. These genomes have the complete functions of HCV and in consequence they are able to produce infectious viruses.

Thus in one embodiment the present invention relates to a method for producing a hepatitis C virus particle of the present invention or parts thereof, comprising culturing a cell or an animal to allow either to produce the virus.

In another embodiment the inventions provides a hepatitis C virus particle obtainable by the method described.

Because the invention provides, inter alia, infectious HCV RNA, the invention provides a method for infecting an animal with HCV, which comprises administering an infectious dose of HCV RNA, such as the HCV RNA transcribed from the plasmids described above, to the animal. Naturally, the invention provides a non-human animal infected with HCV of the invention, which non-human animal can be prepared by the foregoing methods.

In one embodiment the introduced mutations attenuates the virus in vivo.

A further advantage of the present invention is that, by providing a complete functional HCV genome, authentic HCV viral particles or components thereof, which may be produced with native HCV proteins or RNA in a way that is not possible in subunit expression systems, can be prepared.

In addition, since each component of HCV of the invention is functional (thus yielding the authentic HCV), any specific HCV component is an authentic component, i.e., lacking any errors that may, at least in part, affect the clones of the prior art. Indeed, a further advantage of the invention is the ability to generate HCV virus particles or virus particle proteins that are structurally identical to or closely related to natural HCV virions or proteins. Thus, in a further embodiment, the invention provides a method for propagating HCV in vitro comprising culturing a cell line contacted with an infectious amount of HCV RNA of the invention, e.g., HCV RNA translated from the plasmids described above, under conditions that permit replication of the HCV RNA.

In one embodiment, the method further comprises isolating infectious HCV. In another embodiment, the method further comprises freezing aliquots of said infectious HCV.

According to this aspect of the invention, and in one embodiment, the HCV is infectious following thawing of said aliquots, and in another embodiment, the HCV is infectious following repeated freeze-thaw cycles of said aliquots.

A further embodiment of the present invention relates to a method for in vitro producing a hepatitis C virus-infected cell comprising culturing a cell according to the present invention and infecting other cells with the produced virus particle in the culture.

Screening for Anti-Viral Drugs and the Determination of Drug Resistance

It can be assumed that resistance to therapy occurs due to the high mutation rate of the HCV genome. This resistance, which is very important for the clinical approval of a substance, can be detected with the cell culture system according to the invention. Cell lines, in which the HCV-RNA construct or the HCV genome or subgenome replicates and produces infectious viral particles, are incubated with increasing concentrations of the relevant substance and the replication of the viral RNA is either determined by means of an introduced reporter gene or through the qualitative or quantitative detection of the viral nucleic acids or proteins. The release of viral particles is determined by measuring HCV RNA and infectivity titers in the cell culture supernatant. Alternatively, the number of antigen-expressing cells is determined (FIG. 3). Resistance is given if no or a reduced inhibition of the replication and release of viral particles can be observed with the normal concentration of the active substance. The nucleotide and amino acid replacements responsible for the therapy resistance can be determined by recloning the HCV-RNA (for example by the means of RT-PCR) and sequence analysis. By cloning the relevant replacement(s) into the original construct its causality for the resistance to therapy can be proven.

While the replicon systems facilitated testing of drugs interfering with replication such as NS3/4A protease and polymerase inhibitors, the variant genomes obtained in the present invention may prove useful for different research topics.

The systems developed in this invention are ideal candidates for specific testing of therapeutics in general and therapeutics targeting viral entry, assembly and release.

Genomes with the sequences of the present invention are valuable for testing of neutralizing antibodies and other drugs acting on entry level, such as fusion inhibitors.

In one embodiment the present invention relates to a method for identifying neutralizing antibodies.

In another one embodiment the present invention relates to a method for identifying cross-genotype neutralizing antibodies.

In one embodiment the present invention relates to a method of raising neutralizing antibodies.

In another embodiment the present invention relates to a method of raising cross neutralizing antibodies.

In one embodiment the present invention related to a method for screening new HCV genotype 1a, 1b, 2a, 2b, 2c, 3a, 4a, 4d, 5a, 6a and/or 7a inhibitors or neutralizing antibodies, comprising
a) culturing at least one selected from the group consisting of a cell according to the present invention, a hepatitis C virus infected cell according to the present invention and a hepatitis C virus particle obtainable by the present invention together with a hepatitis C virus permissive cell, and
b) subjecting said virus or virus infected cell culture to a blood sample or derivatives thereof from a HCV genotype 1a, 1b, 2a, 2b, 2c, 3a, 4a, 4d, 5a, 6a and/or 7a infected patient
c) detecting the amount of replicating RNA and/or the virus particles.

Inhibitors targeting the HCV non-structural proteins NS3/4A, NS5A and NS5B are currently being developed. The first directly-acting antiviral compounds targeting the NS3/4A protease were licensed in 2011 (Telaprevir and Boceprevir). Clinical phase studies show promising results for inhibitors of NS5A and the NS5B polymerase. The present invention offers novel culture systems where additional HCV isolates can be tested to generate efficient cross-reactive inhibitors.

The p7 peptide features two transmembrane domains (TM1 and TM2), and p7 monomers multimerize to form a putative ion channel. Additionally p7 has been shown to contain genotype specific sequences required for genotype specific interactions between p7 and other HCV proteins. Hence, new compounds targeting the putative p7 ion-channel and autoprotease inhibitors interfering with NS2, and drugs targeting cellular proteins involved in the described processes can be tested.

Thus, one embodiment of the present invention relates to a method for screening an anti-hepatitis C virus substance, comprising
a) culturing at least one selected from the group consisting of a cell according to the present invention, a hepatitis C virus infected cell according to the present invention and a hepatitis C virus particle obtainable by the present invention together with a hepatitis C virus permissive cell,
b) subjecting said virus or virus infected cell culture to the anti-hepatitis C virus substance, and
c) detecting the replicating RNA and/or the virus particles in the resulting culture.

Another embodiment of the present invention relates to a method for screening an anti-hepatitis C virus substance, comprising
  a) culturing at least one selected from the group consisting of a cell according to the present invention and the hepatitis C virus particle according to the present invention together with a hepatitis C virus permissive cell, and
  b) detecting the replicating RNA or the virus particles in the resulting culture.

Yet another embodiment of the present invention relates to a hepatitis C vaccine comprising a hepatitis C virus particle of the present invention or a part thereof.

In another embodiment, the inhibition of HCV replication and/or infection and/or pathogenesis includes inhibition of downstream effects of HCV. In one embodiment, downstream effects include neoplastic disease, including, in one embodiment, the development of hepatocellular carcinoma.

In one embodiment, the invention provides a method of screening for anti-HCV therapeutics, the method comprising contacting a cell with an isolated nucleic acid molecule encoding an infectious recombinant HCV genome, comprising a chimeric HCV genome and contacting the cell with a candidate molecule, independently contacting the cell with a placebo and determining the effects of the candidate molecule on HCV infection, replication, or cell-to-cell spread, versus the effects of the placebo, wherein a decrease in the level of HCV infection, replication, or cell-to-cell spread indicates the candidate molecule is an anti-HCV therapeutic.

In one embodiment, the method may be conducted be in vitro or in vivo. In one embodiment, the cells as described may be in an animal model, or a human subject, entered in a clinical trial to evaluate the efficacy of a candidate molecule. In one embodiment, the molecule is labelled for easier detection, including radio-labelled, antibody labelled for fluorescently labelled molecules, which may be detected by any means well known to one skilled in the art.

In one embodiment, the candidate molecule is an antibody.

Another embodiment of the present invention relates to an antibody against the hepatitis C virus particle of the present invention.

In one embodiment, the term "antibody" refers to intact molecules as well as functional fragments thereof, such as Fab, F(ab')2, and Fv. In one embodiment, the term "Fab" refers to a fragment, which contains a monovalent antigen-binding fragment of an antibody molecule, and in one embodiment, can be produced by digestion of whole antibody with the enzyme papain to yield an intact light chain and a portion of one heavy chain, or in another embodiment can be obtained by treating whole antibody with pepsin, followed by reduction, to yield an intact light chain and a portion of the heavy chain. In one embodiment, the term "F(ab')2", refers to the fragment of the antibody that can be obtained by treating whole antibody with the enzyme pepsin without subsequent reduction, F(ab')2 is a dimer of two Fab' fragments held together by two disulfide bonds. In another embodiment, the term "Fv" refers to a genetically engineered fragment containing the variable region of the light chain and the variable region of the heavy chain expressed as two chains, and in another embodiment, the term "single chain antibody" or "SCA" refers to a genetically engineered molecule containing the variable region of the light chain and the variable region of the heavy chain, linked by a suitable polypeptide linker as a genetically fused single chain molecule.

Methods of producing these fragments are known in the art.

In another embodiment, the candidate molecule is a small molecule. In one embodiment, the phrase "small molecule" refers to, inter-alia, synthetic organic structures typical of pharmaceuticals, peptides, nucleic acids, peptide nucleic acids, carbohydrates, lipids, and others, as will be appreciated by one skilled in the art. In another embodiment, small molecules, may refer to chemically synthesized peptidomimetics of the 6-mer to 9-mer peptides of the invention.

In another embodiment, the candidate molecule is a nucleic acid. Numerous nucleic acid molecules can be envisioned for use in such applications, including antisense, siRNA, ribozymes, etc., as will be appreciated by one skilled in the art.

It is to be understood that the candidate molecule identified and/or evaluated by the methods of this invention, may be any compound, including, inter-alia, a crystal, protein, peptide or nucleic acid, and may comprise an HCV viral product or derivative thereof, of a cellular product or derivative thereof. The candidate molecule in other embodiments may be isolated, generated synthetically, obtained via translation of sequences subjected to any mutagenesis technique, or obtained via protein evolution techniques, well known to those skilled in the art, each of which represents an embodiment of this invention, and may be used in the methods of this invention, as well.

In one embodiment, the compound identified in the screening methods as described, may be identified by computer modelling techniques, and others, as described herein. Verification of the activity of these compounds may be accomplished by the methods described herein, where, in one embodiment, the test compound demonstrably affects HCV infection, replication and/or pathogenesis in an assay, as described. In one embodiment, the assay is a cell-based assay, which, in one embodiment, makes use of primary isolates, or in another embodiment, cell lines, etc. In one embodiment, the cell is within a homogenate, or in another embodiment, a tissue slice, or in another embodiment, an organ culture. In one embodiment, the cell or tissue is hepatic in origin, or is a derivative thereof. In another embodiment, the cell is a commonly used mammalian cell line, which has been engineered to express key molecules known to be, or in another embodiment, thought to be involved in HCV infection, replication and/or pathogenesis.

In another embodiment, protein, or in another embodiment, peptide or in another embodiment, other inhibitors of the present invention cause inhibition of infection, replication, or pathogenesis of HCV in vitro or, in another embodiment, in vivo when introduced into a host cell containing the virus, and may exhibit, in another embodiment, an IC50 in the range of from about 0.0001 nM to 100 µM in an in vitro assay for at least one step in infection, replication, or pathogenesis of HCV, more preferably from about 0.0001 nM to 75 µM, more preferably from about 0.0001 nM to 50 µM, more preferably from about 0.0001 nM to 25 µM, more preferably from about 0.0001 nM to 10 µM, and even more preferably from about 0.0001 nM to 1 µM.

In another embodiment, the inhibitors of HCV infection, or in another embodiment, replication, or in another embodiment, pathogenesis, may be used, in another embodiment, in ex vivo scenarios, such as, for example, in routine treatment of blood products wherein a possibility of HCV infection exists, when serology shows a lack of HCV infection.

In another embodiment, the anti-HCV therapeutic compounds identified via any of the methods of the present invention can be further characterized using secondary screens in cell cultures and/or susceptible animal models. In one embodiment, a small animal model may be used, such as, for example, a tree shrew Tupaia belangeri chinensis. In another embodiment, an animal model may make use of a chimpanzee. Test animals may be treated with the candidate compounds that produced the strongest inhibitory effects in any of the assays/methods of this invention. In another embodiment, the animal models provide a platform for pharmacokinetic and toxicology studies.

Vaccines

The construct according to the invention by itself can also be used for various purposes in all its embodiments. This includes the construction of hepatitis C viruses or HCV-like particles and their production in cell cultures as described.

These HCV or HCV-like particles can be used in particular as vaccine. Thus, one embodiment of the present invention relates to a hepatitis C vaccine comprising a hepatitis C virus particle according to the invention or a part thereof.

In another embodiment, the nucleic acids, vectors, viruses, or viral particles may be further engineered to express a heterologous protein, which, in another embodiment, is mammalian or a derivative thereof, which is useful in combating HCV infection or disease progression. Such proteins may comprise cytokines, growth factors, tumor suppressors, or in one embodiment, may following infection, be expressed predominantly or exclusively on an infected cell surface. According to this aspect of the invention, and in one embodiment, such molecules may include costimulatory molecules, which may serve to enhance immune response to infected cells, or preneoplastic cells, or neoplastic cells, which may have become preneoplastic or neoplastic as a result of HCV infection. In one embodiment, the heterologous sequence encoded in the nucleic acids, vectors, viruses, or viral particles of this invention may be involved in enhanced uptake of a nucleic acids, vectors, viruses, or viral particles, and may specifically target receptors thought to mediate HCV infection.

Further, the present invention relates to a method for producing a hepatitis C virus vaccine comprising using a hepatitis C virus particle according to the invention as an antigen, and naturally any antibody against such hepatitis C virus particle.

Uses

The cell culture system developed of the present invention will be a valuable tool to address different research topics.

It will allow the isolate, subtype and genotype specific study of functions of all HCV genome regions and proteins using reverse genetics.

Accordingly the developed cell culture systems allow individual patient targeting. This means that when a new potential therapeutic candidate is discovered it is possible to test this particular candidate or combination of candidates on novel HCV isolates grown in culture.

Knowing which specific genotype the candidate is functioning towards, it allows an individual treatment of each patient dependent on which specific genotype the patient is infected with. Furthermore these cell culture systems allow the development of antibodies and vaccines targeting individual patients.

The replication level of a virus can be determined, in other embodiments, using techniques known in the art, and in other embodiments, as exemplified herein. For example, the genome level can be determined using RT-PCR, and northern blot. To determine the level of a viral protein, one can use techniques including ELISA, immunoprecipitation, immunofluorescence, EIA, RIA, and Western blotting analysis.

In one embodiment, the invention provides a method of identifying sequences in HCV associated with HCV pathogenicity, comprising contacting cells with an isolated nucleic acid molecule encoding an infectious recombinant HCV genome, comprising a chimeric HCV genome, contacting cells with an isolated nucleic acid molecule comprising at least one mutation of the chimeric HCV genome, independently culturing the cells and determining HCV infection, replication, or cell-to-cell spread, in cells contacted with the mutant, versus the chimeric HCV, whereby changes in HCV infection, replication, or cell-to-cell spread in cells contacted with the mutant virus shows the mutation is in an HCV sequence associated with HCV pathogenicity.

In one embodiment, the invention provides a method of identifying HCV variants with improved growth in cell culture, the method comprising contacting cells with an isolated nucleic acid molecule encoding an infectious recombinant HCV genome, comprising a chimeric HCV genome contacting cells with an isolated nucleic acid molecule comprising at least one mutation of the chimeric HCV genome, independently culturing the cells and determining HCV infection, replication, or cell-to-cell spread, in cells contacted with the chimeric HCV or the mutated virus, whereby enhanced HCV infection, replication, or cell-to-cell spread in cells contacted with the mutated virus shows that the HCV variant has improved growth in cell culture.

In some embodiments, HCV variants are selected for enhanced replication, over a long course of time, in vitro culture systems. According to this aspect of the invention, and in some embodiments, cells contacted with the variants are characterized by reduced infection, as compared to cells contacted with the chimeric HCV.

Kits

In a related aspect, the invention also provides a test kit for HCV comprising HCV virus components, and a diagnostic test kit for HCV comprising components derived from an HCV virus as described herein.

Furthermore the invention also provides test kits, for screening for new HCV inhibitors, neutralizing and cross neutralizing antibodies, comprising HCV virus components.

Method for Identifying Adaptive Mutations and Sequences Comprising them

The present inventors have identified a method for the identification of adaptive mutation, which allow HCV to grow at a more optimal rate.

Thus, one aspect of the present invention relates to a method for obtaining an isolated nucleic acid molecule which encodes a recombinant human hepatitis C virus with adaptive mutations, comprising generating a chimera human hepatitis C virus comprising NS5B or partial NS5B and/or 3' UTR from isolate JFH1 or from isolate J6cc or from isolate J8cc, 5'UTR, Core, E1, E2, p7, NS2, NS3, NS4A, NS4B and NS5A from an isolate that is not JFH1 or J6cc or J8cc or TNcc, transfecting the chimera viral RNAs into a hepatitis C virus permissive cell that allow culturing of the chimera virus, culturing the chimera virus, identification of one or more adaptive mutations in the cultured chimera virus, and isolating a nucleic acid molecule which encodes a chimera human hepatitis C virus with adaptive mutations.

In one embodiment of the present invention is 5'UTR, Core, E1, E2, p7, NS2, NS3, NS4A, NS4B, NS5A, and partial NS5B from an isolate that is not JFH1 which is a genotype selected from the group consisting of 1a, 1b, 2a, 2b, 2c, 3a, 4a, 4d, 5a, 6a and 7a.

In another embodiment of the present invention is 5'UTR, Core, E1, E2, p7, NS2, NS3, NS4A, NS4B, NS5A, and partial NS5B from an isolate that is not JFH1 which is genotype 2a and is isolate J6CF (GenBank accession number: AF177036).

In a further embodiment of the present invention is 5'UTR, Core, E1, E2, P7, NS2, NS3, NS4A, NS4B, NS5A, and partial NS5B from an isolate that is not JFH1 which is genotype 2b and is isolate J8CF (SEQ ID NO:40).

In another embodiment of the present invention relates to the chimera human hepatitis C virus with adaptive mutations obtained from a method according to the above method.

A further aspect of the present invention relates to a method for obtaining an isolated nucleic acid molecule encoding a human hepatitis C virus with adaptive mutations, comprising identification of one or more adaptive mutations as described in the above method, incorporation of said one or more adaptive mutations into a nucleic acid molecule encoding a full length human hepatitis C virus, and isolating the nucleic acid molecule encoding a human hepatitis C virus with adaptive mutations.

One embodiment of the present invention relates to an isolated nucleic acid molecule obtained from the above method.

Another embodiment of the present invention relates to an isolated nucleic acid molecule according to the present invention, wherein the human hepatitis C virus is of a genotype selected from the group consisting of 1a, 1b, 2a, 2b, 2c, 3a, 4a, 4d, 5a, 6a and 7a.

In another embodiment of the present invention the human hepatitis C virus is genotype 2a and is isolate J6CF.

In a further embodiment of the present invention the human hepatitis C virus is genotype 2b and is isolate J8CF (SEQ ID NO:40).

EXAMPLES

Example 1

Robust Full-Length HCV Genotype 2a and 2b Infectious Culture Systems Using Mutations Identified by a Systematic Approach Applicable to Patient Strains (Manuscript)

Introduction

Hepatitis C virus (HCV) infection is a major cause of chronic hepatitis, liver cirrhosis and hepatocellular carcinoma. The infection outcome is associated with genetic variability of HCV and host factors. No vaccine is available and current interferon (IFN)-based treatment is suboptimal, with many side effects, low efficacy against the most prevalent HCV variants and with differential influence from host factors. Directly acting antivirals (DAA) might improve treatment outcome, but also have differential efficacy in treatment of patients with different HCV genotypes.

The HCV positive-sense single-strand RNA genome (~9.6-kb) contains a single open reading frame (ORF) flanked by 5' and 3' untranslated regions (UTR). The ORF encodes virus structural proteins (Core, E1, and E2), p7 and six nonstructural (NS) proteins. HCV isolates are classified into seven major genotypes and numerous subtypes differing by 31-33% and 20-25%, respectively.

High heterogeneity of HCV and lack of representative culture systems have hampered HCV vaccine development, preclinical drug testing, assessment of neutralizing antibodies, and basic HCV research. Although a number of HCV full-length genomes were shown to be infectious in chimpanzees, to date, only the JFH1 strain (genotype 2a) could autonomously replicate in Huh7 human hepatoma cells; efficient growth depended on adaptive mutations.

The low probability of isolating a replication competent HCV genome demands alternative approaches to develop culture systems for HCV isolates. Using the unique replication capacity of JFH1, inter- and intra-genotypic recombinants including Core-NS2, 5'UTR-NS2, NS3 protease/NS4A and NS5A of various genotypes have been developed.

Besides permitting functional studies of specific regions in a genotype-specific manner, these culture systems have been used for testing HCV inhibitors, assessment of neutralizing antibodies, host microRNA-122 silencing, animal model development and HCV entry receptor discovery. The JFH1 recombinants with Core-NS2 or 5'UTR-NS2 from another in vivo infectious genotype 2a clone, J6CF, did not require adaptation for efficient growth.

Both J6 and JFH1 were isolated from Japanese hepatitis C patients. Studies on recombinants containing various JFH1 and J6CF elements demonstrated that the JFH1 NS3 helicase, NS5B polymerase and 3'UTR, as well as specific amino acids (aa), nucleotides (nt) and structural features in NS5B and the 3'UTR were important for the replication capacity of JFH1 in Huh7 cells. Substitutions with JFH1 specific NS5B residues and a nucleotide in the 3'UTR enhanced the J6CF NS5B RNA polymerase activity and the replication of J6CF replicons with JFH1 elements, respectively.

Among other culture systems reported, only H77-S (genotype 1a) carrying mutations in NS3, NS4A and NS5A, identified in the H77 replicon system, was found to enable studies of the HCV life cycle, and its infectivity was improved by an E2 mutation. Nevertheless, the extensive heterogeneity of HCV and genotype specificities in virus production and in response to antivirals and neutralizing antibodies argue for a critical need for developing full-length culture systems for other HCV isolates.

Through a systematic approach, here we identified mutations that enabled replication of in vitro deficient genomes and that permitted establishment of efficient J6 culture systems independent of JFH1 elements. We demonstrated the cross-genotype utility of such mutations by adaptation of a genetically divergent HCV isolate, J8 (genotype 2b). The approach and the identified mutations could possibly be applied to promote the development of full-length culture systems for other HCV patient isolates.

Results

In vitro viability of J6 NS3 helicase, partial NS5B and 3'UTR demonstrated by analyses of J6 recombinants with minimal JFH1 sequences and identification of virus production-enhancing mutations.

The NS3 helicase, NS5B and 3'UTR were previously found to be critical for the unique replication capacity of JFH1, and these genome regions were all included in previously developed JFH1-based HCV genotype recombinants.

Here we demonstrated that the J6 NS3 helicase, NS5B finger, palm and partial thumb domains and 3'UTR were functional for virus production in Huh7.5 cells, and we identified virus production-enhancing mutations F1468L (NS3 helicase) and A1676S (NS4A). Moreover, we demonstrated that a short C-terminal region in JFH1 NS5B contained elements critical for virus production.

J6 NS5B finger-to-partial thumb domain (NS5B aa1-464) was functional for virus production. JFH1 with Core-NS2 and NS5A from J6CF (J6/JFH1 J6NS5A) replicated efficiently in Huh7.5 cells. Here J6/JFH1 J6NS5A recombinants in which we replaced the JFH1 NS5B finger domain [aa1-188], finger-palm domains (aa1-371), or finger-palm-partial thumb domains (aa1-431 or aa1-464) with J6 sequences were found viable in transfected Huh7.5 cells (FIG. 1A and Table S1), indicating that wild-type J6 NS5B aa1-464 was functional for virus production.

Identification of virus production-enhancing mutations F1468L and A1676S through adaptation of J6 recombinant with JFH1 NS5B thumb domain and 3'UTR. Given the results for J6/JFH1 with J6 NS5A-NS5B, the viability of $J6^{5'UTR-NS2}$/JFH1 and J6/JFH1 with J6 NS3/NS4A protease, we tested the viability of J6CF recombinants with the following JFH1 sequences: (i) complete NS5B and 3'UTR [J6(JFH1_5BX); X indicating inclusion of entire 3'UTR with 3'X-region]; (ii) NS5B palm and thumb domains (aa189-591) and 3'UTR [J6(JFH1_5BpalX)]; and (iii) NS5B thumb domain (aa372-591) and 3'UTR [J6(JFH1_5BthuX)].

In transfected Huh7.5 cells, these recombinants had delayed spread with peak infection (≥80% of cells infected) at days 29, 27, and 29, respectively, and reached peak infectivity titers of $10^{3.4}$, $10^{3.9}$ and $10^{3.3}$ focus forming units (FFU)/mL (FIG. 1B). Recovered J6(JFH1_5BthuX) viruses encoded F776S (p7), F1468L (NS3 helicase) and F1676S (NS4A) changes (nt and aa positions based on J6CF, GenBank accession no. AF177036); F776S and A1676S were also found in other genomes (Table 1 and Table S1).

We next engineered these three mutations singly, or in double and triple combinations into J6(JFH1_5BthuX), and tested viability in Huh7.5 cells (FIG. 1C). J6(JFH1_5BthuX) with F1468L/A1676S and F776S/F1468L/A1676S spread to ≥80% of cells within 7 days, reaching peak HCV infectivity titers of $10^{3.6}$FFU/ml (FIG. 1C); in first passage viruses, engineered mutations were maintained (Table S2). Thus, these mutations could effectively promote replication and virus production of J6(JFH1_5BthuX), showing that the J6 helicase and partial NS5B were functional for virus production in cultured cells.

The C-terminal JFH1 NS5B aa465-591 contained elements essential for J6 virus production. Since J6(JFH1_5BthuX)F776S/F1468L/A1676S efficiently spread in Huh7.5 cells without requiring coding changes (FIG. 1C and Table S2) and J6 NS5B aa1-464 was functional for virus production (FIG. 1A), we aimed at minimizing its JFH1 sequence. We thus replaced the following regions with J6CF sequences: (i) 3'UTR; (ii) NS5B aa555-591 and 3'UTR; (iii) NS5B aa372-464 and 3'UTR; or (iv) NS5B aa372-464, aa555-591 and 3'UTR, and tested the viability in Huh7.5 cells (FIG. 1D). The last recombinant was non-viable, without HCV positive cells through 26 days. The other recombinants showed delayed spread with peak HCV infectivity titers of $10^{2.8}$-$10^{3.7}$FFU/ml. In recovered viruses, large deletions were detected in the 3'UTR polyU/UC tract (Table S3). Overall, these data showed that the C-terminal JFH1 NS5B aa465-591 contained elements of importance for rescuing J6 replication, but that the J6 3'UTR was functional in vitro.

Development of Full-Length J6 (Genotype 2a) Culture System

The J6CF genome was previously found to be infectious for chimpanzees, but did not replicate in Huh7.5 cells. We succeeded in identifying mutations that permitted culture of this important reference strain without JFH1 elements, and with HCV infectivity titers comparable to JFH1-based systems. The ORF and polyprotein sequence of JFH1 and J6 differ by 11% and 9%, respectively. We showed that DAA, including NS5B inhibitors, inhibited J6 full-length virus in a dose-dependent manner, and found different sensitivities for J6 full-length and JFH1-based viruses.

J6 full-length genomes with specific mutations were adapted to growth in Huh7.5 cells. Within NS5B aa465-591 of HCV genotype 1-6 strains, M474, H479 and F561 (corresponding to the J6 polyprotein aa L2916, P2921 and Y3003, respectively) were exclusively found in JFH1, while L474, P479 and Y561 were primarily found in other isolates. Recently, JFH1 NS5B aa K517 (J6 aa R2959) and F561, as well as nucleotide G at position 9458 in the 3'UTR variable region (VR) and the length of poly(U/UC) tract were demonstrated to be important for HCV RNA replication.

We demonstrated the importance of F776S/F1468L/A1676S for virus production (FIG. 1C) and recovered shortened polyU/UC tracts from viable J6 recombinants with minimal JFH1 sequences (see above). We thus mutated the corresponding J6CF VR nucleotide (Vm, C9458G) and shortened the J6CF polyU/UC tract to match the length in JFH1 (Δ33U). These modifications (VmΔ33U) were in combination with mutations F776S/F1468L/A1676S/L2916M/P2921H/R2959K/Y3003F (named 7m), F776S/F1468L/A1676S/Y3003F (4m), F1468L/A1676S/Y3003F (3m), or Y3003F introduced into J6CF (FIG. 2A). In addition, a J6CF genome with only the four NS5B mutations L2916M/P2921H/R2959K/Y3003F (J6_4m5B) or with Δ33U (J6_Δ33U) was constructed. In transfected Huh7.5 cells, no HCV positive cells were detected for J6_4m5B, J6_Y3003FVmΔ33U and J6_Δ33U cultures, while J6_7mVmΔ33U, J6_4mVmΔ33U, and J6_3mVmΔ33U cultures became HCV positive and spread to ≥80% of cells at day 20, 13, and 15, respectively (FIG. 2A).

These infections produced HCV peak infectivity titers of $10^{3.3}$, $10^{3.5}$, and $10^{3.6}$ FFU/ml, respectively. In recovered viruses, the engineered mutations were maintained. Interestingly, D3001G (J6 NS5B aa D559G) was the only additional mutation in J6_7 mVmΔ33U and J6_3 mVmΔ33U (Table 2). Thus, combination of F1468L/A1676S/Y3003F with a modified 3'UTR (Vm C9458G and Δ33U) could initiate the replication of the J6 full-length genome in Huh7.5 cells and promote adaptation by long-term culture.

Robust full-length J6 culture systems based on F1468L, A1676S and D3001G mutations. Since D3001G was identified in all three mutated J6 full-length viruses (Table 2) and in a J6 recombinant with JFH1 elements (Table S1), and F1468L/A1676S facilitated replication of J6(JFH1_5BthuX) (FIG. 1B), we introduced F1468L/A1676S/D3001G into J6_Δ33U to obtain J6_LSGΔ33U. Further, Y3003F and Vm C9458G were engineered, singly or in combination, into J6_LSGΔ33U to generate J6_LSGFΔ33U, J6_LSGVmΔ33U and J6_LSGFVmΔ33U (FIG. 2B).

All four recombinants showed efficient HCV replication at day 1 with 20-50% antigen positive cells, and spread to >80% of culture cells within 6 days with peak infectivity titers of $10^{2.7}$ to $10^{3.5}$ FFU/ml. Controls $J6^{5'UTR-NS2}$/JFH1 and wild-type JFH1 had peak HCV infectivity titers of $10^{4.0}$ and $10^{2.8}$ FFU/ml, respectively. No HCV infection was detected for J6CF throughout. In first passage viruses, the engineered mutations were maintained, but ORF changes were identified in J6_LSGΔ33U (Table 3) and J6_LSGFΔ33U (Table 3 legend). Since residues F1468, A1676 and D3001 are identical for J6 and JFH1, we had successfully adapted the J6 full-length genome to efficiently replicate in Huh7.5 cells independent of JFH1 elements.

Additional mutations F776S, P1100L and N1931T/S enhanced virus production of J6_LSGΔ33U. Transfection-recovered J6_LSGΔ33U only reached infectivity titers of $10^{2.5}$-$10^{3.0}$ FFU/ml (range of 10 transfection experiments). However, passage-recovered polyclonal J6_LSGΔ33U viruses reached infectivity titers above $10^{4.0}$ FFU/mL (Table 3), with a peak titer determined from the sixth passage ($10^{4.8}$ FFU/mL), higher than $J6^{5'UTR-NS2}$/JFH1 ($10^{4.2}$-$10^{4.5}$ FFU/mL). Sequence analysis of passaged J6_LSGΔ33U viruses identified additional mutations, of which F776S, P1100L, and N1931T/S, appeared in most viruses (Table 3).

We thus engineered these three mutations singly, or in double and triple combinations, into J6_LSGΔ33U (FIG. 2C). In transfection, the two J6_LSGΔ33U recombinants with all three mutations reached viral infectivity titers of $10^{4.2}$ FFU/ml, equivalent to $J6^{5'UTR-NS2}$/JFH1, and the virus with F776S/P1100L/N1931T did not acquire additional ORF mutations after passage to naïve Huh7.5 cells (Table 3).

Further analysis of the 5'UTR and the 3'UTR of both recombinants revealed that no mutations were required in these regions. We here named the most efficient recombinant, J6_LSGΔ33U(F776S/P1100L/N1931T), "J6cc" (J6 cell culture derived). Thus, we established a robust J6 full-length culture system with infectivity titers comparable to JFH1-based systems.

Mutations adapting J6 enhanced replication and assembly of intracellular infectious HCV particles. To address which steps of the viral life cycle were affected by mutations conferring efficient growth of J6, we first measured intracellular HCV core levels after transfection of S29 cells, a cell line deficient for the putative HCV receptor CD81. J6_LSGΔ33U had only marginal enhancement of replication compared to J6CF.

Introduction of single mutations P1100L, N1931S, N1931T, or triple combinations further increased replication (FIG. 2D). Next, we investigated the effect of these mutations on the production of intracellular infectious HCV. J6_LSGΔ33U was assembly competent, but introduction of single mutations, or combinations increased the production of intracellular infectious virus particles (FIG. 2D). Thus, these mutations apparently enhanced the replication as well as assembly of intracellular infectious HCV particles.

Full-length J6 virus was inhibited by HCV protease, NS5A and NS5B inhibitors in a dose-dependent manner. We previously tested protease and NS5A inhibitors against J6/JFH1, and against J6/JFH1 with J6 NS3/NS4A protease or NS5A. Here, we demonstrated that the full-length J6 culture viruses were inhibited by linear and macrocyclic NS3 protease inhibitors (boceprevir and TMC435, respectively), by NS5A inhibitor daclatasvir (BMS-790052) (FIG. 3A), and by nucleoside (PSI-6130 and NM283) and non-nucleoside (HCV-796) NS5B inhibitors (FIG. 3B) in a dose-dependent manner.

Compared to $J6^{5'UTR-NS2}$/JFH1, the J6 virus and J6/JFH1 with J6-specific NS3/NS4A protease were both less sensitive to TMC435 with 2-3 fold higher median effective concentration (EC50) than that found for $J6^{5'UTR-NS2}$/JFH1, while no apparent difference was observed for boceprevir (FIG. 3C). J6 full-length virus and J6/JFH1 with J6-specific NS5A were both highly resistant to BMS790052 compared to $J6^{5'UTR-NS2}$/JFH1 (FIGS. 3A and C), in agreement with our previous observations with the J6 NS5A recombinant.

The J6 full-length culture system allowed us to test the effect of NS5B inhibitors against J6 NS5B in the context of the complete viral life cycle in vitro. Compared to $J6^{5'UTR-NS2}$/JFH1, the J6 virus was more sensitive to PSI-6130, NM283 and HCV-796 treatment, with around 4, 6 and 2 fold lower EC50, respectively (FIGS. 3*b* and 3*c*). Thus, this study demonstrated strain-specific efficacy of NS5B polymerase inhibitors in vitro.

Development of Full-Length J8 (Genotype 2b) Cell Culture System

There is an urgent need to identify mutations that will permit replication of clinical HCV isolates. Here we demonstrated that mutations of importance for adaptation of J6 could promote adaptation of J8, which is a prototype genotype 2b isolate.

Key mutations adapting full-length J6 initiated replication of HCV strain J8 (genotype 2b) in Huh7.5 cells. Since F1468L, A1676S and D3001G resulted in adaptation of J6, we tested the effect of these mutations on an HCV isolate of another subtype of genotype 2.

We thus generated a consensus full-length cDNA clone of the genotype 2b strain J8 (J8CF) using the sequence determined from virus recovered from a chimpanzee plasma challenge pool. The ORF and polyprotein sequence of J6 and J8 differed by 24% and 16%, respectively. In three Huh7.5 cell transfections, the wild-type J8 did not show evidence of HCV replication through 3-4 weeks, while J8 with three J6-derived mutations F1468L/A1676S/D3001G (named J8_LSG) showed HCV positive cells at day 3 post-transfection. Among three J8_LSG cultures that initially started with <1% HCV antigen positive cells, two cultures (J8_LSGa and J8_LSGb) were followed long-term and spread to 80% at days 60 and 77, respectively, reaching infectivity titers of $10^{3.3}$ and $10^{2.8}$ FFU/ml. In addition, we tested J8_LSG with Y3003F (J8_LSGF)

and detected HCV positive cells at day 3 post-transfection; the infection spread to ≥80% cells at day 81.

After passage to naïve Huh7.5 cells, we recovered viruses with infectivity titers of $10^{3.2}$-$10^{3.6}$ FFU/mL (1st passage) and $10^{3.8}$-$10^{4.2}$ FFU/mL (2nd passage). A number of mutations were identified in transfection- and passage-recovered viruses (Table 4 and Tables S4 and S5). Thus, three J6-derived mutations could initiate J8 replication and promote further adaptation in vitro.

Adaptation of full-length J8 to efficient growth in Huh7.5 cells by additional mutations. Six coding mutations F772C (p7), W864R (NS2), A1208T (NS3), I1968V (NS4B), E2263V (NS5A) and H2922R (NS5B) were identified in J8_LSGa transfection, first and second passage viruses (Table 4 and Table S4). H2922R and I1968V (as quasispecies) were also present in J8_LSGb (Table 4 legend) and J8_LSGF (Table S5), indicating their importance for viability. A partial change at F772, in this case to valine, was also observed in J8_LSGb (Table 4 legend). We thus tested viability in transfected Huh7.5 cells of J8_LSG recombinants with H2922R alone or in combination with each of the other five mutations and F772C/H2922R in combination with each of the other four mutations. All ten mutants showed HCV positive cells at day 1 post-transfection, however, only J8_LSGI1968V/H2922R and J8_LSGF772C/11968V/H2922R spread within 2 weeks, and only J8_LSGF772C/11968V/H2922R spread to the entire culture. Sequence analysis of first passage J8_LSGF772C/11968V/H2922R with infectivity titers of $10^{3.1}$-$10^{3.6}$ FFU/mL identified a number of mutations (Table 4), indicating the need for further adaptation.

Thus, we added W864R, A1208T and E2263V singly, or in double and triple combination, into J8_LSGF772C/11968V/H2922R. The resulting mutants showed HCV positive cells or ~1% infection at day 1 post-transfection. All tested recombinants spread to ~80% of culture cells within 6-10 days. The highest infectivity titers were found for the J8_LSGF772C/11968V/H2922R recombinant with W864R/A1208T/E2263V ($10^{2.7}$-$10^{2.9}$ FFU/mL) (FIG. 2E). After passage to Huh7.5 cells, several such J8 recombinants had infectivity titers of 103.2-103.4 FFU/mL, and did not acquire additional mutations (Table 4 and Table S4). We named the J8_LSGF772C/11968V/H2922R/W864R/A1208T/E2263V recombinant, which was the most efficient among the ones tested, "J8cc" (J8 cell culture derived).

Thus, we had developed J8 full-length genomes with in vitro efficient virus production without requirement for additional mutations.

Discussion

A major challenge for HCV research is the development of culture systems that support replication of clinical HCV isolates. In 2005, Wakita et al. demonstrated that isolate JFH1 (genotype 2a) could replicate and produce infectious virus particles in Huh7.5 cells; its efficient growth required adaptive mutations.

Since then, only a single other genome, H77C (genotype 1a) with replication adaptive mutations, has been found to produce significant titers in culture. We originally showed that H77C was infectious for chimpanzees. We similarly demonstrated that J6CF (genotype 2a) was infectious in vivo, but despite numerous studies by other investigators this full-length clone has not been cultivated in vitro.

In the present study we developed a full-length culture system for J6 and demonstrated how other HCV isolates could potentially be adapted to grow in Huh7.5 cells. By studying J6CF with minimal JFH1 elements or NS5B residues, we identified three key mutations F1468L in NS3, A1676S in NS4A and D3001G in NS5B, which permitted culture replication and further adaptation of full-length J6. We generated genetically stable J6 genomes producing viral infectivity titers comparable to JFH1-based systems.

HCV drugs inhibited J6 virus in a dose-dependent manner, providing proof-of-principle for studies of antivirals targeting any region of the viral genome in the context of the complete viral life cycle in cell culture. Importantly, the three key mutations showed cross-genotype adaptation effect by initiating the replication of a genetically divergent strain, J8 (genotype 2b), and we succeeded in generating several J8 genomes that efficiently produced infectious viruses in vitro, without acquiring additional mutations after viral passage. These two culture systems (J6cc and J8cc) represent a significant advance in HCV research and provide valuable tools for studies of two epidemiologically important HCV genotypes. Importantly, the identified mutations and the approach that we used to establish these culture systems could potentially be applied to further development of culture systems for other HCV patient isolates.

It took 16 years from the discovery of HCV until the first cell culture system was developed for a single HCV isolate and in a single hepatoma derived cell line, and it has proven to be an enormous challenge to grow other full-length HCV isolates. Naturally existing HCV patient isolates are apparently not replication competent in cell culture.

Our study demonstrates a common evolutionary approach to overcome this host restriction and thus has general interest for the studies of other viruses or organisms that have been impossible to culture or for which it has only been possible to culture a limited number of strains, such as other hepatitis viruses.

Although it was a complex process to identify required adaptive mutations, in the end it required a limited number of mutations to overcome a complete host restriction. These unique mutations had the capacity to influence several steps in the viral life cycle, and not only replication. Thus, this knowledge could be of common interest for understanding virus-host interactions. Specific knowledge is available for some of these amino acid positions, but the role of others remains to be studied.

Overall, we identified mutations in p7 (F776S), NS3 (P1100L and F1468L), NS4A (A1676S), NS4B (N1931S/T) and NS5B (D3001G) (FIG. 2C and Table 3) supporting efficient growth of full-length J6; these genome regions play important roles in HCV RNA replication and other steps of the HCV life cycle. F776 in p7 (corresponding to p7 aa26) is conserved among genotype 1, 2 and 3, while P1100, F1468, A1676, N1931 and D3001 are highly conserved among all HCV genotypes (HCV database), indicating their importance for the HCV life cycle. Of these mutations, no direct mutational analysis data were reported for P1100 in the NS3 protease (NS3 aa70), A1676 in the transmembrane α-helix of NS4A (NS4A aa15) and D3001G in the C-terminus of NS5B (NS5B aa559). F776 was mapped within the first transmembrane domain of p7, and F776S increased the infectivity of J6/JFH1 with J6 NS5A, but had no apparent effect on J6/JFH1.

F1468, corresponding to NS3 aa438, is in a Phe-loop motif (DFSLDPTF) within the NS3 helicase that connects two antiparallel sheets between superfamily 2 helicase motifs 5 and 6. Alanine substitution of F1468 resulted in inability of the NS3 helicase to unwind RNA and in inability of Con1 (1B) replicon to form colonies, suggesting its importance for HCV RNA replication. N1931 is located between helices 1 and 2 of the NS4B C-terminus (NS4B aa216) critical for HCV RNA replication.

Alanine substitution of this residue increased virus production of JFH1 and decreased virus production of J6/JFH1 recombinant Jc1, indicating its importance for regulating HCV production, even though the mechanism remains unknown. We demonstrated that these mutations permitted establishment of an efficient J6 culture system by enhancing RNA replication, as well as assembly and release of infectious virus particles (FIG. 2B-E). Importantly, we showed that three of these J6-derived mutations (F1468L, A1676S and D3001G) could promote a replication-incompetent and genetically divergent full-length J8 genome to replicate in Huh7.5 cells, thus allowing further adaptation to efficient growth in Huh7.5 cells with infectivity titers of $10^{3.6}$ FFU/mL (Table 4).

Even though the J8 isolate belongs to genotype 2b, it varies significantly from J6, with 24% difference at the ORF nucleotide level. The J8 NS5B polymerase sequence differs by ~13% from J6 and JFH1. It should be noted that the identified mutations are different from those in the H77 adapted genome, whose ability to adapt other HCV isolates was not reported.

Thus, the J6-derived adaptive mutations identified here could potentially initiate the replication of other HCV genotype isolates. Moreover, J8-derived mutations tested in this study were also conserved in genotypes 1, 2, 3 and 7 for F772, in genotypes 1, 2, 3, 5, 6 and 7 for W864, in genotypes 1, 4, 5 and 6 for A1208, in genotype 2, 3, 4 and 5 for I1968, in genotypes 1, 2b and 7 for E2263 and in genotypes 2 and 4 for H2922 (HCV databases). Thus, in future studies the capacity of these mutations to aid the development of other full-length HCV culture systems could be investigated.

Numerous HCV patient isolates have been identified and a number of full-length HCV clones have proved infectious in vivo, however, only JFH1 could autonomously replicate in cultured cells. This highlights a low probability of isolating an in vitro-replication competent HCV genome and thus argue for an urgent need for a systematic approach that permits the development of culture systems for HCV isolates.

Natural existence of quasispecies of HCV validates the development of a culture system by introducing replication- and/or virus production-enhancing mutations into a consensus genome sequence. Nevertheless, identification of such mutations has been difficult, as replication-enhancing mutations identified in the Con1 (1b) replicon system were found to impair in vitro virus assembly and in vivo infectivity.

We took advantage of the replication capacity of the JFH1 NS5B polymerase and successfully identified mutations from culture, which permitted adaptation of full-length J6 and J8. Since culture-derived mutations may be most efficient in aiding replication of full-length HCV isolates, it might be advantageous to utilize the high replication capacity of the JFH1 NS5B polymerase to adapt isolate-specific 5'UTR-NS5A or 5'UTR-partial NS5B recombinants to a highly permissive cell line, e.g. Huh7.5 cells; this may identify mutations permitting the replication of a full-length HCV genome as shown here.

As the J6-derived mutations increased RNA replication, virus assembly and release (FIG. 2B-D), and had a general adaptive effect for J8 (FIG. 2E), these mutations could potentially also facilitate the adaptation process of other genotype recombinants with JFH1 NS5B- or partial NS5B-3'UTR regions. Therefore, the mutations identified in this study, in combination with the approach leading to their identification may be able to break the barrier of culturing HCV in vitro, and thus pave the way towards development of full-length culture systems for clinical HCV isolates.

With J6 and J8 full-length culture systems, all HCV inhibitors can now be tested, either in single or in combination treatments, at an isolate-specific level. As an example of the utility of these culture systems, we demonstrated that the newly developed J6 full-length virus and J6/JFH1 with J6 or with JFH1 NS3/NS4A protease and NS5A, responded differentially to protease inhibitors and NS5A inhibitor daclatasvir (BMS-790052) (FIG. 3), although J6 and JFH1 belong to the same subtype. Importantly, we compared the efficacy of NS5B inhibitors against J6 full-length or recombinants with JFH1 NS5B polymerase in culture, which was not previously possible due to lack of a robust culture system with J6 NS5B. Interestingly, differential responses to three NS5B inhibitors were evident (FIGS. 3B and C), even though J6 and JFH1 differ only by 5% in the NS5B aa sequence. This indicates that more variable efficacy of these NS5B inhibitors or other antivirals may exist among HCV variants with higher degree heterogeneity.

However, it should be noted that it cannot be excluded that cell culture adaptive mutations in recombinants used for in vitro testing could have an impact on sensitivity to the tested antivirals. Even though the observations made in cell culture require verification in the clinical setting, additional full-length HCV culture systems are needed to allow screening for antivirals with universal effect on various genotypes, or of new drugs targeting any regions of the HCV protein or RNA. Development of full-length J6cc and J8cc culture systems and possibly additional systems meets these needs and will be a major asset to the hepatitis C field.

These culture systems will directly contribute to and also provide an alternative example of the development of HCV full-length culture systems for HCV patient isolates, with application for HCV vaccine and drug development, and for better individualized treatment of HCV infected patients.

Materials and Methods

Plasmids

PCR-fused or synthesized (GenScript, USA) chimeric NS5B or NS5B-to-3'UTR with J6 and JFH1 sequences were cloned into J6/JFH1-J6NS5A or J6CF (FIG. 1A-D). Mutations in full-length J6 and J8 genomes were generated by PCR or synthesized (GenScript). For J6 recombinants, G was inserted between T7 promoter and the HCV 5'UTR to enhance in vitro-transcription. All recombinant constructs were sequenced covering T7 promoter and the entire HCV genome.

Construction of Full-Length J8 Genome

The 5'UTR-NS2 sequence of J8 was previously determined, using an experimentally infected chimpanzee plasma pool. Using virus recovered from this plasma pool, the NS3 to NS5B sequence was determined by sequencing three overlapping RT-PCR amplicons, covering nucleotides 2522 to 9474 [according to J8 sequence (GenBank accession no. D10988)]. A consensus sequence from 5-7 clones were synthesized (GenScript) and cloned into $p38^{5'UTR-NS2}$/JFH1 to generate pJ8/J8. The 3'UTR variable region and polyU/UC tract were amplified by nested-PCR, cloned and sequenced. A representative sequence was determined from 14 clones with different polyU/UC length. The 3'UTR X-region sequence was taken from JPUT971017 (genotype 2b) (AB030907). The entire 3'UTR together with upstream NS5B sequence to Sse232I site was synthesized (GenScript) and cloned into pJ8/J8 by Sse232I-XbaI sites to obtain full-length J8 plasmid, pJ8CF.

Transfection and infection of Huh7.5 cells. The human hepatoma cell line Huh7.5 was maintained as described. Twenty-four hours before transfection or infection, $4.2\times10^5$ cells/well were seeded in 6-well plates. For transfections, 10

μg of HCV recombinant plasmid was linearized with XbaI, treated with Mung Bean Nuclease (NEB), purified, and in vitro-transcribed using T7 RNA Polymerase (Promega) (total 100 μl). The resulting HCV RNA transcripts were mixed with 150 μl Opti-MEM (Invitrogen) and incubated for 10 min at room temperature, mixed with 255 μl transfection complex [5 μl of Lipofectamine 2000 (Invitrogen) in 250 μl of Opti-MEM with 10 min incubation], incubated for 20 min, and added drop-wise into the Huh7.5 cell cultures that have been pre-incubated in 2 ml of Opti-MEM for 20 min. The transfected cultures were left for ~16 hours, and sub-cultured every 2-3 days; the supernatant was collected, filtered (0.45 μm) and stored at −80° C. To passage virus, Huh7.5 cells grown in 6-well plates were incubated with 1 ml transfection-collected culture supernatant for ~16 hours, and sub-cultured every 2-3 days.

Determination of virus infection, HCV infectivity titers and HCV RNA titers. Monoclonal anti-core antibody B2 (Anogen) was used for immunostaining for HCV core for J6/JFH1 and full-length J6 viruses, and monoclonal anti-NS5A antibody 9E10 was used for J8 viruses, as previously described. The percentage of HCV antigen positive cells was estimated using fluorescence microscopy and used as an indication for the status of HCV infection in the culture. HCV infectivity titers were determined by FFU assay as previously described. Primary monoclonal anti-core antibody C7-50 (Enzo Life Sciences) was used in 1/500 dilutions for J6 recombinant and full-length viruses [NS3 helicase monoclonal antibody H23 (Abcam) was used for experiments in FIG. 1A]. 9E10 was used in 1/1000 dilutions for J8 viruses. The number of FFU was manually counted using a light microscope or automatically counted by an ImmunoSpot Series 5 UV Analyzer with customized software (CTL Europe GmbH). The viral infectivity titers (FFU/mL) are averages from three independent infections. Supernatant HCV RNA titers were determined using real time RT-PCR TaqMan assay as previously described.

Sequence analysis of the culture-derived HCV. ORF sequence analysis of the J6 recombinant viruses with JFH1 sequences were previously described. For J6 and J8 full-length viruses, ORF RT-PCR primers are given in Table S6. The 5'UTR and 3'UTR sequence were determined using 5'RACE Systems for Rapid Amplification of cDNA Ends (Invitrogen) with dA or dC tailing technology, as previously described. HCV RNA extracted from culture supernatant was used for 5'UTR 5'RACE. HCV negative strand RNA extracted from infected cells was used in 5'RACE to determine 3'UTR sequence; primers are given in Table S6.

Determination of intracellular HCV core and infectivity titer. HCV RNA transcripts were transfected into HCV entry-deficient cell line, S29. As previously described, HCV core level at 4 and 48 hours post-transfection was determined by ELISA, and intracellular HCV infectivity titer, at 48 hours were determined on by FFU assay on Huh7.5 cells.

HCV antiviral treatment. HCV antivirals were purchased from Acme Bioscience (Palo Alto, Calif.) and dissolved in dimethyl sulfoxide. Huh7.5 cells grown in poly-D-lysine-coated 96-well plates (Nunc) were infected with HCV and treated with antivirals 24 and 48 hours post-infection as previously described. Single HCV core positive cells were determined by immunostaining with C7-50 (Enzo Life Sciences) 72 hours post-infection. No cytotoxic effects were observed in inhibitor treatments, as shown previously for NS3/NS4A protease and NS5A inhibitors, and monitored in this study for NS5B inhibitors using CellTiter 96® AQueous One Solution Cell Proliferation Assay (Promega).

Example 2

Robust Full-Length HCV Genotype 2a and 2b Replication Systems Using Mutations Identified by a Systematic Approach Applicable to Patient Strains (Author Summary)

Approximately 2-3% of the world population is chronically infected with hepatitis C virus (HCV), which can cause liver cirrhosis and cancer. Based on analysis of their genome sequence HCV patient isolates have been classified into seven highly diverse major genotypes and numerous subtypes. Beside biological differences, genotypes, subtypes and even isolates within the same type respond differently to current interferon-based treatment, and to newly released drugs that disrupt the function of important viral protein.

There is no vaccine. Basic HCV research required for vaccine and drug development has been hampered by inability to culture patient isolates, but in 2005 it was found that the JFH1 (genotype 2a) recombinant grew in cultured human Huh7 and Huh7.5 hepatoma cells.

To facilitate HCV research and obtain basic knowledge for better and individualized treatment, we aimed at developing culture systems for other HCV patient isolates. We adopted a systematic approach, which led to the identification of mutations, namely nucleotide or amino acid (aa) sequence changes that enabled HCV RNA replication and virus particle formation in cultured cells. Using these mutations, we succeeded in growing HCV genotype 2a and 2b full-length recombinants in Huh7.5 cells, named J6cc (J6 cell culture derived) and J8cc culture systems, respectively. Our study gives renewed hope for allowing growth of other clinically relevant viral HCV isolates.

The HCV genome is a positive-sense single-strand RNA (~9600 bases) consisting of a single open reading frame (ORF), directing the synthesis of 10 viral proteins, flanked by 5' and 3' untranslated regions (UTR). Based on JFH1, recombinants that contain different regions of other HCV genotype isolates were constructed and found viable in cultured cells.

These recombinants were used for testing HCV drugs and antibodies as well as for studies of function of genetic elements. Through the study of HCV recombinants containing various regions of JFH1 and another genotype 2a clone named J6CF, viable in chimpanzees but not in cultured cells, several regions were found to be critical for the viability of JFH1, including (i) NS3 helicase, an enzyme that separates the viral RNAs during replication; (ii) NS5B RNA polymerase, an enzyme that produces copies of the viral RNA genome; (iii) 3'UTR and (iv) specific aa of the NS5B and RNA structures in NS5B and 3'UTR.

Based on this knowledge, we initially tested HCV recombinants with various J6CF and JFH1 regions by HCV RNA transfection of Huh7.5 cells. We collected viruses from the transfection culture fluid, used them to infect naive Huh7.5 cells (referred to as viral passage), and analyzed the sequence of the recovered viruses. We first demonstrated that partial J6 NS5B (aa1-464 of a total of 591 amino acids) was functional in a JFH1 helicase-containing recombinant. We then tested J6 helicase-containing recombinants and found that they were viable in cells but acquired mutations, indicating that the J6 helicase was functional in the cells.

By introducing selected mutations back into the J6 recombinant with only partial JFH1 NS5B (aa372-591) and 3'UTR regions, we demonstrated that combination of mutations F776S [Phenylalanine at aa position 776 changed to Serine]/ F1468L/A1676L or F1468L/A1676S permitted viral viability. With the three mutations identified, a J6 recombinant with only a short JFH1 NS5B sequence (aa 465-591) was viable. Within this region, JFH1 contained four unique amino acids. We thus introduced F776S, F1468L/A1676S and these four JFH1-type amino acids, in different combinations, into J6CF, which permitted viral viability of this full-length clone in cell culture. After long-term culture, we recovered three viruses with a common mutation D3001G in NS5B and with large deletions in the 3'UTR.

With this knowledge, we finally introduced mutations F1468L/A1676S/D3001G and Δ33U (33 U deletion in the 3'UTR) into J6CF to make J6_LSGΔ33U, a recombinant without any JFH1 elements. J6_LSGΔ33U was viable and spread efficiently in culture cells. After passage, its viability was comparable to JFH-based recombinants; however, it acquired additional mutations at three positions (F776S, P1100L and N1931S or N1931T). Introduction of these mutations, in different combinations, into J6_LSGΔ33U increased virus viability further; J6_LSGΔ33U recombinants with additional mutations at all 3 positions were most efficient.

The RNA sequence of one of these recombinants did not change after viral passage, indicating genetic stability, and we named this virus "J6cc" (J6 cell culture derived) (FIG. 14). Thus, we demonstrated that an in vitro replication deficient HCV patient isolate could be made viable by specific mutations, and we generated a robust J6 full-length culture system with viral titers comparable to JFH1-based systems.

To validate the J6cc viruses and their utility, we tested drugs against the HCV NS3/NS4A protease (an enzyme that cleaves the viral polyprotein), NS5A (a viral protein important for virus replication) and the NS5B RNA polymerase. These drugs inhibited J6 full-length viruses in a dose-dependent manner.

In order to determine the cross-genotype utility of J6cc adaptive mutations, we constructed a full-length genotype 2b recombinant from prototype isolate J8. J8 differs from J6CF by 24% of its ORF sequence. We tested the viability of J8 with and without three J6-derived mutations F1468L/A1676S/D3001G (LSG).

Only J8_LSG showed HCV positive cells after transfection of Huh7.5 cells. After long-term culture, we harvested viruses with numerous mutations, including F772C, W864R, A1208T, I1968V, E2263V and H2922R. We introduced these mutations singly or in combinations into J8_LSG and tested viability of the resulting recombinants. Several combinations of mutations enhanced the viral viability, however, J8_LSG with all six mutations was the most efficient virus (FIG. 14). After passage to naïve Huh7.5 cells, it did not acquire additional mutations. We named this recombinant "J8cc" (J8 cell culture derived). Thus, we developed genetically stable J8 full-length virus with efficient virus production in cultured cells, showing that 3 mutations permitting replication of a genotype 2a isolate (J6) could make an in-vitro replication defective 2b isolate (J8) viable.

In summary, we have successfully developed full-length HCV genotype 2a and 2b infectious culture systems; these are epidemiologically important HCV genotypes. These two culture systems (J6cc and J8cc) represent a significant advance in HCV research and provide valuable tools to the hepatitis C field. It took 16 years from the discovery of HCV until the first cell culture system was developed for a single HCV isolate and in a single hepatoma derived cell line, and it has proven to be an enormous challenge to grow other full-length HCV isolates in vitro.

Naturally existing HCV patient isolates are apparently not replication competent in cell culture. Our study demonstrates a common evolutionary approach to overcome this host restriction and thus has general interest for the studies of other viruses or organisms that have been impossible to culture or for which it has only been possible to culture a limited number of strains, such as other hepatitis viruses.

The identified unique cell culture adaptive mutations could contribute to a more fundamental understanding of the nature of host restriction in the study of microorganisms. For the HCV field, the identified mutations and the approach that we used could potentially be applied to develop unique culture systems for other HCV patient isolates. Such culture systems could contribute to HCV vaccine and drug development, and to better, individualized treatment of HCV infected patients.

Example 3

Highly Efficient Full-Length Hepatitis C Virus Genotype 1 (Strain TN) Infectious Culture System Introduction Chronic infection with hepatitis C virus (HCV) is an important cause of end stage liver disease worldwide. In the U.S.A. most HCV-related disease is associated with genotype 1 infection, which remains difficult to treat.

Drug and vaccine development was hampered by inability to culture patient isolates representing HCV genotypes 1-7 and subtypes; only a recombinant 2a genome (strain JFH1) spontaneously replicated in vitro.

In the previous examples the inventors identified three mutations, designated LSG, in the nonstructural (NS) proteins, essential for development of full-length HCV 2a (J6) and 2b (J8) culture systems in Huh7.5 cells.

Here, the inventors have developed a highly efficient genotype 1a (strain TN) full-length culture system.

The inventors initially found that the LSG substitutions conferred viability to an intergenotypic recombinant composed of TN 5'UTR-NS5A and JFH1 NS5B-3'UTR; recovered viruses acquired two adaptive mutations located in NS3 and NS4B. Introduction of these changes into a replication-deficient TN full-length genome, harbouring LSG, permitted efficient HCV production. Additional identified NS4B and NS5B mutations fully adapted the TN full-length virus.

Thus, a TN genome with 8 changes (designated TNcc) replicated efficiently and released infectious particles of ~5 log 10 FFU/ml; passaged TNcc did not require additional changes. Interferon-α and directly acting antivirals targeting the HCV protease, NS5A, and NS5B, each inhibited full-length TN infection dose-dependently.

Given the unique importance of genotype 1 for pathogenesis, this infectious 1a culture system represents an important advance in HCV research.

The approach used and the mutations identified might permit culture development for other HCV isolates, thus facilitating vaccine development and personalized treatment.

Results

Hepatitis C virus (HCV) chronically infects an estimated 130-170 million people worldwide. The infection increases the risk of developing liver cirrhosis and liver cancer and results in more than 350,000 deaths annually. No HCV vaccine is available.

Current standard treatment is based on interferon-α/ribavirin, which however has low efficacy against the most prevalent HCV variants. Incorporation of directly acting antivirals (DAA) in treatment regimens improves sustained viral response rate, but a favorable outcome is challenged by fast emergence of drug resistance and differential responses of the different HCV genotypes.

Thus, HCV infection continues to be a huge health and economic burden to the world population, and improved in vitro experimental systems would be important to permit additional studies of new antivirals and associated resistance patterns.

HCV is a small enveloped virus belonging to the genus Hepacivirus in the family Flaviviridae.

The HCV genome is a positive-sense single-strand RNA (~9.6-kb) consisting of a single open reading frame (ORF) flanked by 5' and 3' untranslated regions (UTR).

The ORF encodes virus structural proteins (Core, E1, and E2), p7 and six nonstructural (NS) proteins NS2, NS3, NS4A, NS4B, NS5A, and NS5B. HCV isolates are classified into seven major variants (genotypes 1-7) and numerous subtypes (a, b, etc.) differing by ~30% and ~20%, respectively, in nucleotide and amino acid sequences. Genotype 1 is the most prevalent in the world. In the U.S.A., Japan, China, and southern Europe over 70% of HCV patients are infected with genotype 1.

In northern Europe, genotype 1 accounts for ~50% of HCV infections. Genotype 1 infection is more resistant to interferon-based treatment than infection with other genotypes.

In vitro HCV culture systems are needed to study treatment regimens and associated viral resistance. However, drug and vaccine development have been greatly hampered by inability to culture patient isolates in vitro. Although a number of HCV full-length clones were shown to be infectious in chimpanzees, only JFH1 (genotype 2a) spontaneously replicated in Huh7 human hepatoma cells and released infectious virus particles.

Efficient growth of JFH1 required culture adaptive mutations. Recently, the inventors reported efficient J6cc (2a) and J8cc (2b) full-length culture systems; subsequently Date et al. reported on a full-length system for 2a strain JFH2.

A single full-length genotype 1a genome, H77-S, carrying mutations identified in the subgenomic replicon of the same strain has been reported to release relatively small amounts of virus particles. The Con1 (1b) full-length culture system was reported, but a very low level of replication has limited its utility.

Thus, efficient HCV full-length culture systems remained limited to genotype 2 isolates. The clinical importance of the marked genetic differences between HCV genotype isolates poses a critical need for development of robust full-length culture systems for HCV genotype 1 isolates.

The unique replication capacity of JFH1 has permitted the development of JFH1-based HCV recombinants; the inventors and others have reported different inter- and intra-genotypic recombinants including Core-NS2, 5'UTR-NS2, NS3 protease/NS4A, NS5A, and Core-NS3 protease plus NS4A-NS5A of various genotypes. These JFH1-based culture systems have been used for genotype-specific studies of HCV genes, for testing of HCV DAAs and neutralizing antibodies, and for studying aspects of virus-host interaction.

Through studies of J6 (2a) recombinants with the entire or partial NS5B and 3'UTR from JFH1, the inventors recently identified two adaptive mutations in NS3 and NS4A, designated LS. Combination of LS with selected mutations in NS5B and the 3'UTR allowed replication of the full-length J6 genome, which led to the identification of an additional unique mutation in NS5B, designated G.

The LSG substitutions permitted the development of robust HCV full-length culture systems for J6 and for the prototype genotype 2b J8 strain.

In this study, the inventors used LSG, as a critical component, and a unique approach to develop a highly efficient full-length genotype 1a (strain TN) infectious culture system, named TNcc.

The TNcc replicated efficiently in culture, released viral particles of ~$10^5$ focus forming units (FFU)/ml and did not require additional mutations after viral passage.

The inventors have demonstrated that full-length TN responded dose-dependently to interferon-α, as well as HCV DAAs already used in the clinic and being tested in clinical trials.

HCV genotype 2-derived LSG mutations permitted adaptation of genotype 1a (strain TN) recombinant with JFH1 NS5B-3'UTR.

In examples 1 and 2 the inventors developed full-length HCV genotype 2a (J6cc) and 2b (J8cc) infectious culture systems using mutations F1464L (NS3 helicase), A1672S (NS4A) and D2979G (NS5B), designated LSG.

All positions of nucleotides and amino acids (aa) for TN-JFH1 chimera recombinant and TN full-length recombinants are according to the HC-TN genome (GenBank accession number EF621489).

In the present study, the inventors attempted to use the LSG mutations for development of a full-length HCV genotype 1 cell culture system.

The inventors selected a genotype 1a strain, HC-TN, which was originally isolated from a patient with fulminant hepatitis, and for which the inventors previously demonstrated that its consensus molecular clone was infectious in chimpanzees but not in Huh7.5 cells.

Using JFH1-based recombinants, the inventors have demonstrated that the TN Core-NS2, NS5A, and 5'UTR-NS3 protease and NS4A-NS5A regions were functional in Huh7.5 cells.

Thus, and also given our recent finding on viability of J6-JFH1 chimeras, in this study the inventors generated a TN recombinant with only NS5B and 3'UTR from JFH1, designated TN(JFH1_5BX) (X indicating inclusion of the entire 3'UTR with 3'X region), and tested its viability by RNA transfection of Huh7.5 cells.

No HCV positive cells were detected for up to 22 days by immunostaining for HCV Core or NS5A.

Figure 15A:
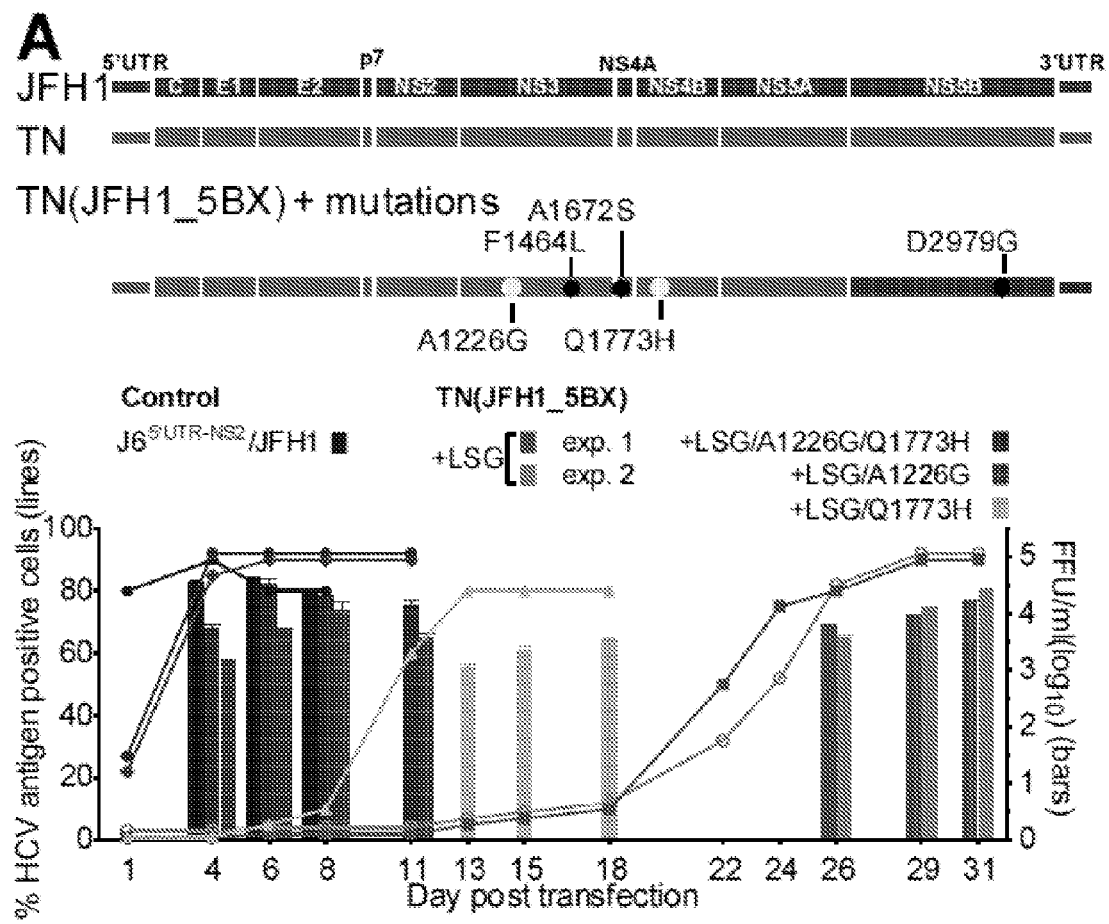

Since the LSG mutations enhanced HCV RNA replication, virus particle assembly and release of the full-length J6 virus, the inventors next introduced them into TN(JFH1_5BX) (FIG. 15A).

In two independent transfections of TN(JFH1_5BX)_LSG, HCV positive cells were detected at day 4 and the virus spread to most of the cultured cells in 24 and 26 days (FIG. 15A).

In infected cultures peak supernatant HCV infectivity titers were $10^{4.2}$-$10^{4.4}$ FFU/ml, comparable to the titers of control cultures infected with J6 5'UTR-NS2/JFH1 ($10^{4.3}$-$10^{4.6}$ FFU/ml) (FIG. 15A).

Viruses recovered from supernatants of transfection cultures could be passaged to naïve Huh7.5 cells, and the first passage viruses produced titers of $10^{4.4}$ FFU/ml (FIG. 16). ORF sequence analysis of first passage viruses revealed two coding changes in both viruses, A1226G in the NS3 helicase (NS3 aa position 200) and Q1773H (NS4B aa 62) (FIGS. 16 and 17), indicating their importance for the viability of TN(JFH1_5BX)_LSG.

Next, the inventors introduced A1226G and Q1773H, singly or in combination, into TN(JFH1_5BX)_LSG (FIG. 15A). The TN(JFH1_5BX)_LSG/A1226G and TN(JFH1_5BX)_LSG/A1226G/Q1773H recombinants showed 20-30% HCV positive cells on day 1 and reached the peak of infection (≥80% HCV-positive cells) on day 4 post transfection, with supernatant peak infectivity titers of $10^{4.1}$ and $10^{4.5}$ FFU/ml, respectively.

TN(JFH1_5BX)_LSG/Q1773H showed delayed spread kinetics and a peak titer of only $10^{3.9}$FFU/ml. Following passage to naïve Huh7.5 cells, TN(JFH1_5BX)_LSG/A1226G/Q1773H (peak titer $10^{4.5}$ FFU/ml) and TN(JFH1_5BX)_LSG/A1226G ($10^{3.9}$FFU/ml) did not acquire additional coding changes.

TN(JFH1_5BX)_LSG/Q1773H ($10^{5.0}$ FFU/ml) acquired two mutations in NS3 helicase, including A1226G, indicating the importance of co-occurrence of A1226G and Q1773H (FIGS. 16 and 17).

Taken together, the inventors demonstrated that previously identified genotype 2-adapting LSG mutations could initiate replication of a genotype 1 specific 5'UTR-NS5A recombinant. Mutations A1226G and Q1773H identified in cultures infected with the TN intergenotypic 5'UTR-NS5A recombinant further adapted the virus to efficient growth in Huh7.5 cells.

Development of highly efficient full-length TN infectious culture systems based on LSG and A1226G/Q1773H mutations. Since A1226G or the combination A1226G/Q1773H could efficiently adapt TN(JFH1_5BX) (FIGS. 15, 16 and 17), the inventors engineered them into a TN full-length genome with LSG and Y2981F [NS5B aa 561], designated TN_LSGF.

LSGF substitutions were previously shown to permit adaptation of full-length genotype 2 strains, J6 and J8. However, after RNA transfection of TN_LSGF in Huh7.5 cells, the inventors did not observe any HCV positive cells during 4 weeks of follow-up.

Figure 15B:
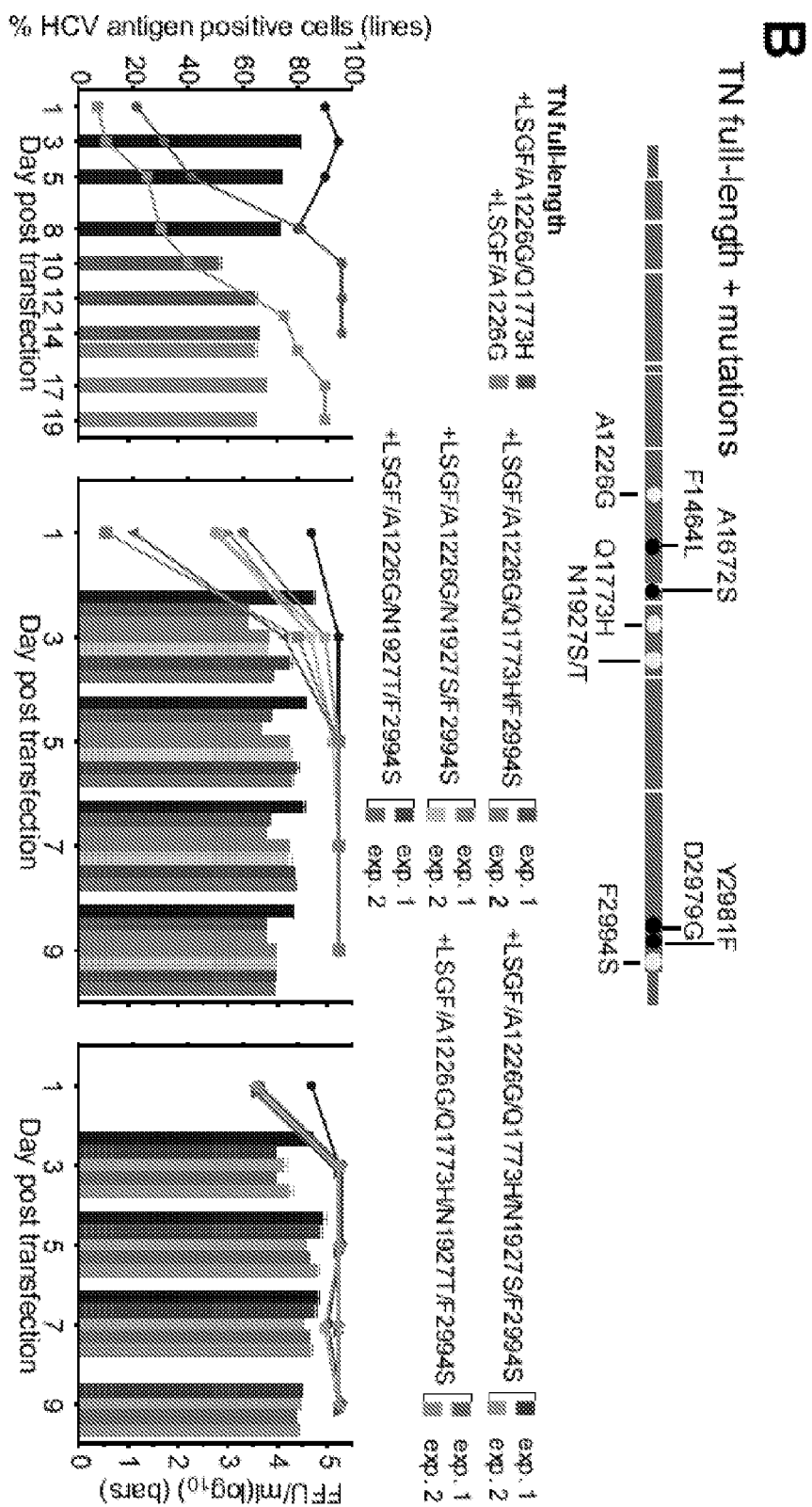

In contrast, transfection of TN_LSGF/A1226G and TN_LSGF/A1226G/Q1773H showed 5% and 20% HCV positive cells on day 1, reached peak infection within 13 and 8 days, and produced peak supernatant titers of $10^{3.8}$ and $10^{3.6}$FFU/mL, respectively (FIG. 15B; left panel). Transfection-recovered TN_LSGF/A1226G and TN_LSGF/A1226G/Q1773H could be passaged to naïve Huh7.5 cells, and first passage viruses reached peak titers of $10^{4.5}$ and $10^{4.9}$FFU/ml, respectively (FIGS. 16 and 17).

The second, third, and fourth passage TN_LSGF/A1226G/Q1773H viruses reached peak titers of $10^{5.1}$, $10^{5.5}$, and $10^{5.4}$ FFU/ml, respectively.

Thus, the inventors had adapted the TN full-length genome to efficiently replicate and produce infectious virus particles in Huh7.5 cells, using previously identified genotype 2 LSGF mutations combined with TN mutations A1226G/Q1773H identified in the present study.

ORF sequence analysis of first passage viruses revealed that both TN_LSGF/A1226G and TN_LSGF/A1226G/Q1773H had common changes as quasispecies at two positions: N1927N/S/T (NS4B aa 216) and F2994F/S (NS5B aa 574) (FIGS. 16 and 17).

F2994F/S became a complete change, F2994S, in the fourth passage TN_LSGF/A1226G/Q1773H virus ($10^{5.4}$ FFU/ml).

Thus, the inventors introduced F2994S singly into TN_LSGF/A1226G/Q1773H. Since the N1927N/S/T mutations were previously shown to improve the viability of J6_LSG, and co-existed here with F2994F/S in first and second passage TN_LSGF/A1226G (FIGS. 16 and 17), the inventors introduced combinations N1927S/F2994S or N1927T/F2994S into TN_LSGF/A1226G. In duplicate transfection experiments, TN_LSGF/A1226G/Q1773H/ F2994S showed 10% and 20% HCV positive cells on day 1 and peak titers of $10^{3.8}$ and $10^{3.9}$ FFU/ml, respectively (FIG. 15B, middle panel).

The TN_LSGF/A1226G/N1927S/F2994S and TN_LSGF/A1226G/N1927T/F2994S recombinants showed 50%-60% HCV positive cells at day 1 in duplicate transfections, and reached peak of infection within 3 days (FIG. 15B, middle panel); infected cultures produced peak titers of $10^{4.3}$-$10^{4.4}$FFU/ml, similar to the titers of first passage TN_LSGF/A1226G (FIGS. 16 and 17).

Since combinations N1927S/F2994S or N1927T/F2994S greatly increased virus production of TN_LSGF/A1226G, the inventors tested their effect in TN_LSGF/A1226G/Q1773H, viability of which was only marginally increased by single mutation F2994S. In duplicate transfection experiments, the TN_LSGF/A1226G/Q1773H/N1927S/F2994S and TN_LSGF/A1226G/Q1773H/N1927T/F2994S recombinants both showed 60%-70% HCV positive cells on day 1 and reached peak infection within 3 days (FIG. 15B, right panel).

The infections produced peak titers of $10^{4.6}$-$10^{4.9}$FFU/ml, similar to the titers of first passage TN_LSGF/A1226G/Q1773H (FIGS. 16 and 17) and comparable to the included transfection control J65'UTR-NS2/JFH1 ($10^{4.7}$-$10^{4.9}$FFU/ml) (FIG. 15B; right panel).

Transfection-derived adapted TN viruses were passaged to naïve Huh7.5 cells, with peak infectivity titers of $10^{4.6}$-$10^{4.7}$FFU/ml (FIG. 16). The inventors sequenced viruses from one replicate passage culture for each recombinant.

TN_LSGF/A1226G/N1927T/F2994S had no coding changes, but a single non-coding change (C4748C/T). In TN_LSGF/A1226G/N1927S/F2994S and LSGF/A1226G/Q1773H/N1927T/F2994S, the inventors did not observe coding or non-coding changes (FIGS. 16 and 17).

TN_LSGF/A1226G/Q1773H/N1927T/F2994S showed specific infectivity of ~1/400 (FFU/IU) (FIG. 17), and the inventors designated this virus "TNcc" (for "TN cell-culture derived").

Thus, the inventors established a highly efficient HCV genotype 1 full-length culture system with infectivity titers comparable to those from the most efficient JFH1-based systems, such as Jc1 and SA13/JFH1, using a unique approach that permits identification of efficient adaptive mutations.

Full-length TN virus was inhibited by HCV protease-, NS5A-, and NS5B polymerase-inhibitors and by interferon-α2b in a dose-dependent manner. The TN full-length culture system allows testing of DAAs targeting any genomic element or protein expressed by the viral genome and of interferon-α in the context of the complete viral life cycle in vitro.

To validate the TN full-length culture system, the inventors demonstrated that the TN full-length virus was dose-dependently inhibited by linear [telaprevir (VX-950) and boceprevir (SCH503034)] and macrocyclic [simeprevir (TMC435)] NS3 protease inhibitors, by NS5A inhibitor daclatasvir (BMS-790052), by nucleotide NS5B inhibitor PSI-7977, and by interferon-α2b (FIG. 18A).

The first passage TN_LSGF/A1226G/Q1773H virus stock was used for these experiments (FIG. 16). Median effective concentration (EC50) of NS5A inhibitor daclatasvir for TN full-length virus (0.032 nM) (FIG. 18B) was similar to that of J6/JFH1-based recombinant with TN NS5A (0.042 nM), thus validating TN full-length and TN-specific NS5A recombinant culture systems in the studies of antiviral treatment. Compared to J6/JFH1, TN full-length virus was more sensitive to telaprevir, boceprevir, daclatasvir and simeprevir, with about 2-5 fold lower EC50, while no apparent difference was observed for PSI-7977 and interferon-α2b (FIG. 18B).

Discussion

In this study, the inventors developed a highly efficient full-length HCV genotype 1 cell culture system, TNcc. The TNcc replicated efficiently following transfection and produced HCV infectivity titers of ~5 log 10 FFU/ml.

This titer level is orders of magnitude higher than published systems for other genotype 1 strains, and comparable to the most efficient JFH1-based chimeric culture systems. First passage TNcc did not require additional changes. Thus, the development of TNcc is a significant advance in HCV research and provides a valuable tool for HCV studies, especially on HCV genotype 1, the most prevalent genotype in the world.

Recently, the inventors developed full-length infectious culture systems of HCV genotype 2a (J6cc) and 2b (J8cc) using mutations F1464L/A1672S/D2979G (LSG) identified through studies of J6 recombinants. These results suggested that a limited number of mutations could confer viability to a replication-deficient HCV genome in cultured cells, and that mutations identified for genotype 2 may enable adaptation of other HCV genotype isolates.

Here, by a unique approach utilizing the genotype 2-derived mutations and an in vivo functional HCV genome, HC-TN, the inventors developed a robust full-length HCV genotype 1 culture system.

The inventors demonstrated that genotype 2-adapting mutations LSG could initiate adaptation of a non-viable HCV genotype 1 (strain TN) specific 5'UTR-NS5A recombinant in Huh7.5 cells, which led to identification of additional mutations A1226G (NS3 helicase) and Q1773H (NS4B).

These TN mutations, in combination with genotype 2-adapting mutations, permitted efficient virus production and further adaptation of the TN full-length virus.

After discovery of HCV in 1989, only a single HCV isolate (JFH1, genotype 2a) was found to be able to replicate autonomously in a hepatoma derived cell line, Huh7, and release infectious virus. This breakthrough was not accomplished until 2005.

Other HCV culture systems have been reported, however, none was found to release infectious virus at a level high enough to study the HCV life cycle.

The H77-S (1a) system with H77 replicon mutations was the only genotype 1a isolate reported to be able to, albeit inefficiently, infect Huh7.5 cells and release infectious virus particles. Apparently, infectivity could be improved by introducing additional mutations, but the details have not been published, and the titers indicated remain relatively low.

A genotype 1b isolate, Con1, was reported to produce virus particles in vitro, but quantitative virological assays could not be performed due to low level of replication. Thus, the TNcc system permits detailed virological studies and applications previously difficult or not possible for genotype 1 viruses.

There is apparently a low probability of obtaining from a patient an HCV genome with replication capacity in vitro. Host restriction is believed to account for a distinct and narrow tissue and host species tropism of HCV.

Therefore, it is important to develop approaches that will enable researchers to overcome the host barrier for the growth of the pathogen in vitro and in vivo.

Development of full-length HCV infectious genotype 1a, 2a, and 2b culture systems by use of a limited number of mutations has exemplified that introducing specific mutations into a consensus full-length genome could overcome such host barriers. This knowledge could be of overall interest for understanding virus-host interactions and for the development of culture systems or animal models for other viruses or pathogens that have similar host restrictions.

Identification of adaptive mutations permitting replication of full-length HCV genome in vitro has been difficult. Mutations identified in the Con1 (1b) replicon enhanced RNA replication but impaired in vitro virus assembly and in vivo infectivity.

Although other mutations identified from strain-specific subgenomic replicons permitted the replication of H77-S (1a) and JFH2 (2a), their effect on different isolates of HCV genotypes has not been reported. Since host restriction could affect any step of the HCV life cycle, mutations selected from productive infectious culture systems must harbor the ability to bypass each of those steps.

Possibly such mutations could overcome some key universal host restrictions, thus having a pan-genotypic effect. The LSG mutations were identified from infectious culture systems and have been proven to adapt different genotype 2 strains, J6 (2a) and J8 (2b), and in this study genotype 1a strain TN (FIG. 15B).

Thus the LSG mutations apparently have adaptation effects across HCV genotypes.

Therefore, compared to replicon-derived mutations, infection-selected mutations may be advantageous in aiding replication of full-length HCV genomes.

Acquiring replication capacity is a critical step for evolutionary selection of beneficial mutations that can overcome the blocks of the viral life cycle.

The JFH1 NS5B polymerase could initiate the replication of recombinants of various HCV genotypes, which led to the identification of numerous adaptive mutations, including those adapting full-length HCV genomes (FIG. 15A).

Therefore, the use of the unique replication capacity of the JFH1 NS5B RNA polymerase to initiate the replication of a strain specific 5'UTR-NSSA recombinant may be an efficient approach to identify mutations permitting replication of full-length HCV genomes, as the inventors here demonstrated for TNcc (FIG. 15). In future studies it would be of great interest to examine this approach for culture development of other HCV genotype isolates.

The inventors have here identified TN-adapting mutations A1226G in the NS3 helicase, Q1773H in NS4B, and F2994S in NS5B (FIGS. 15B and 16). A1226 (NS3 aa 200) is highly conserved among HCV genotype 1 and 4 isolates, while glycine was found at this position for genotype 2, 3, 5, 6, and 7 isolates (The Los Alamos HCV Sequence Database).

In a recent study, an A1226G substitution was shown to enhance replication of an ED43 (4a) subgenomic replicon. Q1773 (NS4B aa 62) localizes to the N-terminal amphipathic α-helix AH2 domain of NS4B; this position is conserved for all HCV genotypes.

The α-helix AH2 contributes to NS4B association with membranes and is a major determinant for NS4B oligomerization, which is required for the formation of a functional replication complex.

Interestingly, the changes N1927S/T (NS4B aa 216), which we previously found to improve the J6 full-length system, were also identified in several TN full-length viruses and enhanced TN viral infectivity (FIGS. 15 and 16).

Thus, N1927S/T has cross-genotype adaptive activity. N1927 is located in the NS4B C-terminal end and may also regulate the HCV infection cycle in JFH1 and JFH1-based recombinant Jc1. F2994 is located in the C-terminal transmembrane segment of NS5B, a region important for HCV production, and is conserved among HCV genotype 1a isolates, while tryptophan and leucine are dominant in genotype 1b and other genotypes.

It should be noted that mutations identified in this study are different from those previously found in TN-infected chimpanzees.

Thus, these mutations may be specific for cell culture. Previously identified LSG are highly conserved among all HCV genotypes (The Los Alamos HCV Sequence Database), and enhanced HCV RNA replication and virus assembly.

In future studies it would be of interest to investigate the specific mechanism of the identified TN mutations for adaptation of TN isolate and the utility of these mutations, or various combinations, for development of other full-length HCV culture systems.

It is also a possibility that the TN-derived mutations are specific for adaptation of genotype 1 isolates, thus in future studies it would be of interest to test the effect of these mutations in genotype 1a isolate H77 or 1b isolate Con1; as mentioned above both genomes were previously shown to be viable in culture, with low level titers, after introduction of other mutations.

Figure 18:
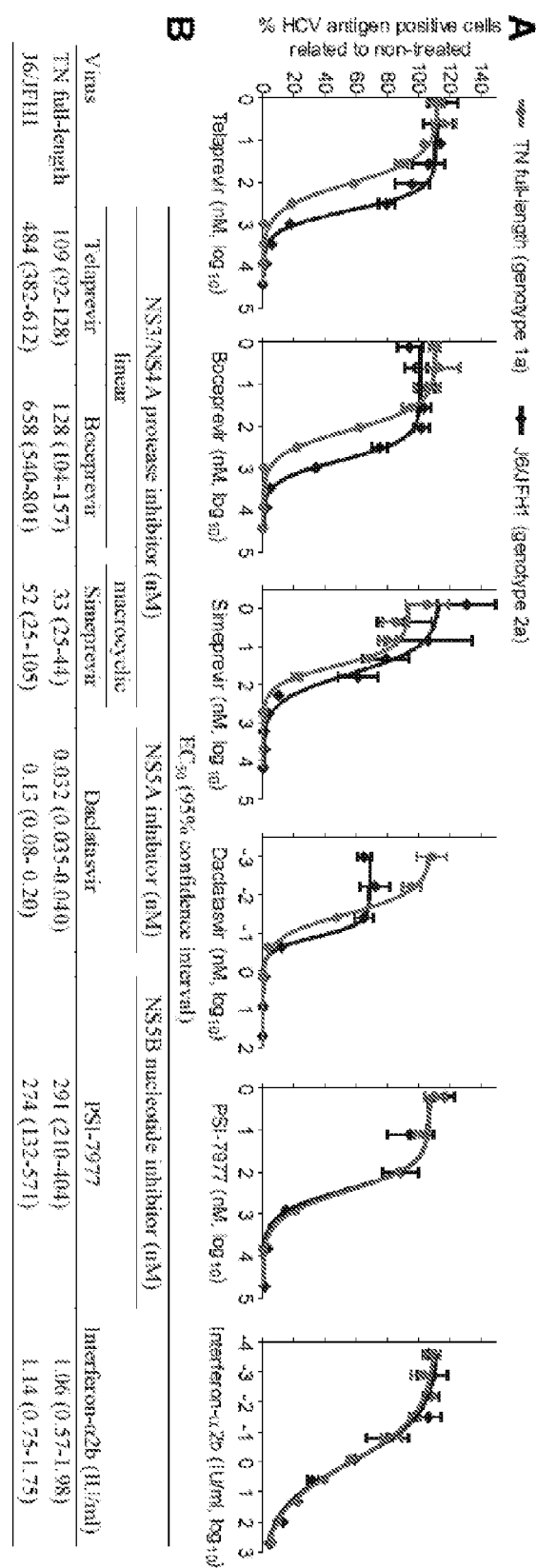

With TNcc, all HCV inhibitors can now be tested at an isolate-specific level. To validate the TN full-length culture system, the inventors here demonstrated that TN full-length viruses responded to NS3/4A protease-, NS5A-, and NS5B-inhibitors, respectively, and to interferon-α2b in a dose dependent manner (FIG. 18). TNcc (1a) and J6/JFH1 (2a) responded similarly to interferon-α2b treatment.

Thus, the observed difference in the effect of interferon in HCV genotype 1 and 2 patients was not found in the inventors' in vitro assay.

Interestingly, compared to J6/JFH1, TN full-length virus was more sensitive to the protease inhibitors telaprevir, boceprevir, and simeprevir, and the NS5A inhibitor daclatasvir, with similar sensitivity to the NS5B inhibitor PSI-7977.

Higher efficacy against genotype 1 may result from the fact that the development of these HCV specific drugs was based on genotype 1 sequences.

No NS5B inhibitor was previously tested for full-length HCV genotype 1 virus in culture. Here, the inventors demonstrated that a lead NS5B inhibitor PSI-7977 could efficiently inhibit HCV of genotypes 1 and 2, thus confirming its cross-genotype antiviral effect (FIG. 18). None of the mutations in TN full-length virus were located in the NS3 protease sequence (FIG. 16), thus lower EC50 for TN full-length most likely reflect the actual drug sensitivity of the TN isolate.

However, it cannot be excluded that adaptive mutations outside protease regions could have an impact on sensitivity to the tested drugs.

Thus, a better understanding of the specific interactions between the different HCV proteins in drug resistance is needed and may be achieved by the development of additional full-length HCV culture systems for different genotypes and subtypes.

In conclusion, the inventors have developed a highly efficient full-length HCV genotype 1 culture system, TNcc.

This system may prove to be a major asset to the hepatitis C field by directly contributing to drug development and pre-clinical screening of drugs that will optimize treatment regimens in HCV genotype 1 infected patients.

The TNcc, in combination with other genotype culture systems, may facilitate development of drugs with universal effect for different HCV genotypes.

The approach and identified mutations used for developing the TNcc culture system may also facilitate the culture development of HCV full-length systems for most HCV patient isolates, with application for HCV vaccine and drug development, and for better individualized treatments.

Materials and Methods
Plasmids

Partial TN NS5A and JFH1 NS5B-3'UTR (BbvCI-XbaI digested) of J6/JFH1(TN-NS5A) was cloned into full-length HC-TN clone (GenBank accession number, EF621489) to make TN(JFH1_5BX). Mutations in TN(JFH1_5BX) or in full-length TN genomes were generated by PCR, site-directed mutagenesis by QuikChange (Agilent Technologies, USA), or chemically synthesized (GenScript, USA). T7 promoter was inserted immediately upstream of the TN 5'UTR to initiate in vitro-transcription. All final plasmid preparations were sequenced covering T7 promoter and the entire HCV genome.

Transfection and infection of Huh7.5 cells. The human hepatoma cell line Huh7.5 was cultured. Twenty-four hours before transfection or infection, cells were seeded in 6-well plates (~4.0×10$^5$ cells/well) and had reached 80-90% confluence at the time of transfection.

Transfection and infection procedures were previously described. The transfected or infected cultures were left for ~16 hours, and sub-cultured every 2-3 days; the supernatant was collected, filtered (0.45 µm), and stored at −80° C.

Analysis of HCV in cultured cells. Monoclonal anti-Core antibodies B2 (Anogen, Canada) or C7-50 (Enzo Life Sciences, Germany) and anti-NS5A antibody 9E10 were used for immunostaining for HCV, as previously described.

The percentage of HCV antigen positive cells was estimated under fluorescence microscopy and used as an approximate indication of the status of HCV infection in the culture.

HCV infectivity titers were determined by FFU assay. Anti-NS5A 9E10 was used in 1/1000 dilutions for TN(JFH1_5BX) recombinant viruses. A combination of C7-50 (1/500) and 9E10 (1/1000) was primarily used for full-length viruses; the combination staining overall increased the intensity of immunostaining for HCV infected cells without affecting the infectivity titer, as determined for control J65'UTR-NS2/JFH 1.

The number of FFU was automatically counted with an ImmunoSpot Series 5 UV Analyzer with customized software (CTL Europe GmbH). Supernatant HCV RNA titers were determined using real time RT-PCR TaqMan assay as previously described. ORF sequence analysis of the TN recombinant viruses with JFH1 NS5B-3'UTR sequences and TN full-length virus was previously described.

HCV antiviral treatment. HCV DAAs were purchased from Acme Bioscience (Palo Alto, Calif.) and dissolved in dimethyl sulfoxide. Inerferon-α2b was purchased from Schering-Plough (Kenilworth, N.J.). The EC50 value of telaprevir (VX-950), boceprevir (SCH503034), simeprevir (TMC435), daclatasvir (BMS-790052), and interferon-α2b against positive control J6/JFH1 were comparable to our previous determinations, verifying the reproducibility of our treatment assays.

Briefly, Huh7.5 cells grown in poly-D-lysine-coated 96-well plates (Nunc) were infected with HCV and treated with DAAs 24 hours post-infection. Treatment with interferon-α2b was performed at 24 and 48 hours post-infection. Single HCV Core and NS5A positive cells were determined 72 hours post-infection by immunostaining with combination of C7-50 (Enzo Life Sciences) and 9E10 antibodies. Dose response curves were fitted and EC50 values with 95% confidence interval were calculated in GraphPad Prim 4 (Graphpad).

A cytotoxicity assay was performed for PSI-7977, as we had not used this drug previously. The non-cytotoxic dose range for telaprevir, boceprevir, simeprevir, daclatasvir, and interferon-α2b was determined. No cytotoxic effects were observed at the doses used in this study.

SEQUENCE LISTING (158 sequences)

SEQ ID NO: 1 - DNA, 9678 bp, Artificial Sequence
  Plasmid
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 2 - DNA, 9678 bp, Artificial Sequence
  Plasmid
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 3 - DNA, 9678 bp, Artificial Sequence
  Plasmid
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 4 - DNA, 9678 bp, Artificial Sequence
  Plasmid
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 5 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacttcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgccgcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 6 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacttcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgccgcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 7 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacttcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgccgcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 8 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 9 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgccgcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 10 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacttcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 11 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 12 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacttcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgccgcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 13 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgccgcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 14 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacttcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 15 - DNA, 9711 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacattagctacactccatagctaactgtcccttttttttttttttttttttttttttttttttttttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 16 - DNA, 9711 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttatcacagcgtgtcgcgtgcccgaccccgcttattgctctttggcctactcctactttttgtaggggtaggccttttcctactccccgctcggtagagcggcacacattagctacactccatagctaactgtcccttttttttttttttttttttttttttttttttttttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 17 - DNA, 9711 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacattagctacactccatagctaactgtcccttttttttttttttttttttttttttttttttttttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 18 - DNA, 9696 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttatcacagcgtgtcgcgtgcccgaccccgcttattgctctttggcctactcctactttttgtaggggtaggccttttcctactccccgctcggtagagcggcacacattagctacactccatagctaactgtccctttttttttttttttttttttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 19 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctatgcacacatacactcaccacgaactgacacgggtggcttcagccctcagaaaacttggggcgccacccctcagagcgtggaagagccgggcacgtgcagtcagggcgtccctcatctcccgtggggggaaagcggccgtttgcggtcgatatctcttcaattgggcggtgaagaccaagctcaaactcactccattgccggaagcgcgcctcctggatttatccagctggttcaccgtcggcgccggcgggggcgacatttttcacagcgtgtcgcgtgcccgaccccgcttattgctctttggcctactcctactttttgtaggggtaggccttttcctactccccgctcggtagagcggcacacattaggtacactccatagctaactgtccctttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 20 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggtcgatatctcttcaattgggcggtgaagaccaagctcaaactcactccattgccggaagcgcgcctcctggatttatccagctggttcaccgtcggcgccggcgggggcgacatttttcacagcgtgtcgcgtgcccgaccccgcttattgctctttggcctactcctactttttgtaggggtaggccttttcctactccccgctcggtagagcggcacacattaggtacactccatagctaactgtccctttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 21 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggtcgatatctcttcaattgggcggtgaagaccaagctcaaactcactccattgccggaagcgcgcctcctggatttatccagctggttcaccgtcggcgccggcgggggcgacatttttcacagcgtgtcgcgtgcccgaccccgcttattgctctttggcctactcctactttttgtaggggtaggccttttcctactccccgctcggtagagcggcacacattaggtacactccatagctaactgtccctttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 22 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacttcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgccgcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggtcgatatctcttcaattgggcggtgaagaccaagctcaaactcactccattgccggaagcgcgcctcctggatttatccagctggttcaccgtcggcgccggcgggggcgacatttttcacagcgtgtcgcgtgcccgaccccgcttattgctctttggcctactcctactttttgtaggggtaggccttttcctactccccgctcggtagagcggcacacattaggtacactccatagctaactgtccctttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 23 - DNA, 9711 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacttcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgccgcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctatgcacacatacactcaccacgaactgacacgggtggcttcagccctcagaaaacttggggcgccacccctcagagcgtggaagagccgggcacgtgcagtcagggcgtccctcatctcccgtggggggaaagcggccgtttgcggtcgatatctcttcaattgggcggtgaagaccaagctcaaactcactccattgccggaagcgcgcctcctggatttatccagctggttcaccgtcggcgccggcgggggcgacatttttcacagcgtgtcgcgtgcccgaccccgcttattgctctttggcctactcctactttttgtaggggtaggccttttcctactccccgctcggtagagcggcacacattagctacactccatagctaactgtcccttttttttttttttttttttttttttttttttttttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 24 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacttcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgccgcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggtcgatatctcttcaattgggcggtgaagaccaagctcaaactcactccattgccggaagcgcgcctcctggatttatccagctggttcaccgtcggcgccggcgggggcgacatttatcacagcgtgtcgcgtgcccgaccccgcttattgctctttggcctactcctactttttgtaggggtaggccttttcctactccccgctcggtagagcggcacacattagctacactccatagctaactgtccctttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 25 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggtcgatatctcttcaattgggcggtgaagaccaagctcaaactcactccattgccggaagcgcgcctcctggatttatccagctggttcaccgtcggcgccggcgggggcggcatttatcacagcgtgtcgcgtgcccgaccccgcttattgctctttggcctactcctactttttgtaggggtaggccttttcctactccccgctcggtagagcggcacacattagctacactccatagctaactgtccctttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 26 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggtcgatatctcttcaattgggcggtgaagaccaagctcaaactcactccattgccggaagcgcgcctcctggatttatccagctggttcaccgtcggcgccggcgggggcggcatttttcacagcgtgtcgcgtgcccgaccccgcttattgctctttggcctactcctactttttgtaggggtaggccttttcctactccccgctcggtagagcggcacacattagctacactccatagctaactgtccctttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 27 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggtcgatatctcttcaattgggcggtgaagaccaagctcaaactcactccattgccggaagcgcgcctcctggatttatccagctggttcaccgtcggcgccggcgggggcggcatttatcacagcgtgtcgcgtgcccgaccccgcttattgctctttggcctactcctactttttgtaggggtaggccttttcctactccccgctcggtagagcggcacacattaggtacactccatagctaactgtccctttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 28 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggtcgatatctcttcaattgggcggtgaagaccaagctcaaactcactccattgccggaagcgcgcctcctggatttatccagctggttcaccgtcggcgccggcgggggcggcatttttcacagcgtgtcgcgtgcccgaccccgcttattgctctttggcctactcctactttttgtaggggtaggccttttcctactccccgctcggtagagcggcacacattaggtacactccatagctaactgtccctttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 29 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggtcgatatctcttcaattgggcggtgaagaccaagctcaaactcactccattgccggaagcgcgcctcctggatttatccagctggttcaccgtcggcgccggcgggggcggcatttatcacagcgtgtcgcgtgcccgaccccgcttattgctctttggcctactcctactttttgtaggggtaggccttttcctactccccgctcggtagagcggcacacattagctacactccatagctaactgtccctttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 30 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtctggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggtcgatatctcttcaattgggcggtgaagaccaagctcaaactcactccattgccggaagcgcgcctcctggatttatccagctggttcaccgtcggcgccggcgggggcggcatttatcacagcgtgtcgcgtgcccgaccccgcttattgctctttggcctactcctactttttgtaggggtaggccttttcctactccccgctcggtagagcggcacacattagctacactccatagctaactgtccctttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 31 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaagtcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggtcgatatctcttcaattgggcggtgaagaccaagctcaaactcactccattgccggaagcgcgcctcctggatttatccagctggttcaccgtcggcgccggcgggggcggcatttatcacagcgtgtcgcgtgcccgaccccgcttattgctctttggcctactcctactttttgtaggggtaggccttttcctactccccgctcggtagagcggcacacattagctacactccatagctaactgtccctttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 32 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaactcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggtcgatatctcttcaattgggcggtgaagaccaagctcaaactcactccattgccggaagcgcgcctcctggatttatccagctggttcaccgtcggcgccggcgggggcggcatttatcacagcgtgtcgcgtgcccgaccccgcttattgctctttggcctactcctactttttgtaggggtaggccttttcctactccccgctcggtagagcggcacacattagctacactccatagctaactgtccctttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 33 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtctggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggtcgatatctcttcaattgggcggtgaagaccaagctcaaactcactccattgccggaagcgcgcctcctggatttatccagctggttcaccgtcggcgccggcgggggcggcatttatcacagcgtgtcgcgtgcccgaccccgcttattgctctttggcctactcctactttttgtaggggtaggccttttcctactccccgctcggtagagcggcacacattagctacactccatagctaactgtccctttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 34 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaagtcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggtcgatatctcttcaattgggcggtgaagaccaagctcaaactcactccattgccggaagcgcgcctcctggatttatccagctggttcaccgtcggcgccggcgggggcggcatttatcacagcgtgtcgcgtgcccgaccccgcttattgctctttggcctactcctactttttgtaggggtaggccttttcctactccccgctcggtagagcggcacacattagctacactccatagctaactgtccctttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 35 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaactcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggtcgatatctcttcaattgggcggtgaagaccaagctcaaactcactccattgccggaagcgcgcctcctggatttatccagctggttcaccgtcggcgccggcgggggcggcatttatcacagcgtgtcgcgtgcccgaccccgcttattgctctttggcctactcctactttttgtaggggtaggccttttcctactccccgctcggtagagcggcacacattagctacactccatagctaactgtccctttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 36 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtctggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaagtcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggtcgatatctcttcaattgggcggtgaagaccaagctcaaactcactccattgccggaagcgcgcctcctggatttatccagctggttcaccgtcggcgccggcgggggcggcatttatcacagcgtgtcgcgtgcccgaccccgcttattgctctttggcctactcctactttttgtaggggtaggccttttcctactccccgctcggtagagcggcacacattagctacactccatagctaactgtccctttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 37 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtctggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaactcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggtcgatatctcttcaattgggcggtgaagaccaagctcaaactcactccattgccggaagcgcgcctcctggatttatccagctggttcaccgtcggcgccggcgggggcggcatttatcacagcgtgtcgcgtgcccgaccccgcttattgctctttggcctactcctactttttgtaggggtaggccttttcctactccccgctcggtagagcggcacacattagctacactccatagctaactgtccctttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 38 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtctggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaagtcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggtcgatatctcttcaattgggcggtgaagaccaagctcaaactcactccattgccggaagcgcgcctcctggatttatccagctggttcaccgtcggcgccggcgggggcggcatttatcacagcgtgtcgcgtgcccgaccccgcttattgctctttggcctactcctactttttgtaggggtaggccttttcctactccccgctcggtagagcggcacacattagctacactccatagctaactgtccctttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 39 - DNA, 9678 bp, Artificial Sequence
  Plasmid
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtctggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacctcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgcctcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaactcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggtcgatatctcttcaattgggcggtgaagaccaagctcaaactcactccattgccggaagcgcgcctcctggatttatccagctggttcaccgtcggcgccggcgggggcggcatttatcacagcgtgtcgcgtgcccgaccccgcttattgctctttggcctactcctactttttgtaggggtaggccttttcctactccccgctcggtagagcggcacacattagctacactccatagctaactgtccctttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 40 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtttttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcgccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacttcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcagcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctggatcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagaggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccacgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcgacatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 41 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtttttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcgccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctggatcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagaggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccacgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 42 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtttttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcgccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctggatcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagaggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccacgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttttcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 43 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtttttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcgccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctggatcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagaggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 44 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtgtttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcgccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctggatcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagaggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 45 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtttttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcaccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctggatcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagaggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 46 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtttttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcgccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctgggtcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagaggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 47 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtttttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcgccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctggatcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagaggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcagtccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 48 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtttttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaacgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcgccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctggatcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagaggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 49 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtttttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcgccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctggatcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagtggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 50 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtgtttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcgccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctggatcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagaggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcagtccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 51 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtgtttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcaccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctggatcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagaggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 52 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtgtttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaacgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcgccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctggatcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagaggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 53 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtgtttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcaccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctgggtcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagaggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 54 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtgtttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcaccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctgggtcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagaggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcagtccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 55 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtgtttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaacgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcgccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctggatcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagtggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 56 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtgtttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaacgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcaccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctgggtcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagtggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 57 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtgtttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcgccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctggatcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagtggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 58 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtgtttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcgccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctgggtcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagtggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 59 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtttttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcgccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctgggtcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagtggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 60 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtgtttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcaccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctgggtcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagtggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 61 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtgtttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaacgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcaccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctgggtcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagaggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 62 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtgtttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaacgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcgccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctgggtcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagtggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 63 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtgtttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaacgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcgccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctgggtcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagaggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 64 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtgtttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaacgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcaccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctgggtcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagtggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcagtccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 65 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtgtttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaacgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcaccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttgccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctgggtcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagaggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 66 - DNA, 9659 bp, Artificial Sequence
  Plasmid
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctgaactggtctccaactcttgccatgatcctcgcctacgccgctcgtgttcccgagatggtcctcgaaattattttcggcggccattggggtgtggtgtttggcttggcctacttctccatgcaaggagcgtgggccaaagtcattgccatcctccttcttgttgcgggagtggatgcaaccacctattccagcggccaggaagcgggtcgtaccgtcttggggttcactaacctctttacttctggtgccaagcagaacctctatttaatcaacaccaatggcagctggcacataaaccggactgccctcaattgcaatgacagcttacagacgggtttcatggcttccctgttttacacccacaggttcaacagctctggctgccccgagcgcttgtcttcctgccgcgggctggacgattttcgcatcggctggggaaccttggaatacgaaacccacgtcaccaacgatgaggacatgaggccgtactgctggcattaccctccgaggccttgcggcatcgtcccggctagaacggtttgcggaccggtctattgtttcacccctagccctgttgtcgtgggcaccactgacaagcagggcgtacccacctacacctggggggaaaacgagaccgatgtcttcctgctgaatagcacaagacccccgcgaggagcttggttcggctgcacttggatgaacgggactgggttcactaagacatgcggtgcaccaccttgccgcattaggaaagactacaacagcactatcgatttattgtgccccacagactgttttaggaagcaccccgatgctacctatcttaagtgtggagcagggccttggttaactcccaggtgcctggtagactacccttatagactgtggcattatccgtgcactgtaaacttcaccatctttaaggcgcggatgtatgtaggaggggtggagcatcgattctccgcagcatgcaacttcacgcgcggagatcgctgcagactggaagatagggataggggtcagcagagtccactgctgcattccactactgagtgggcggtgctcccatgctccttctctgacctaccagcactatccactggcctattgcacctccaccaaaacatcgtggacgtgcagtacctttacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtgtttcatcttctttacagcggcctggtacttaaagggcagggtggtccccgtggccacgtactctgttctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaacgggttccccccctggaggtccgaggggggcgtgacggaatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcaccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttgccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagccattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactctgtcatcgactgtaatgttgcagtctctcagattgttgacctcagcctagacccaaccttcaccatcaccactcaaatcgtccctcaggacgctgtctcccgtagtcaacgtagagggagaactgggagggggcgattgggcgtttacaggtatgtttcgtcaggcgaaaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcatcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtagcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggggcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctgggtcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacagggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctcgactccctcgattccatgactgaggtagtggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggaggggatcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacggtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcagtccattagacctaccggccataattgaaaggctacatgggcttgaagccttttcactgcacacatactctccccgcgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcggcatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttgttttttttttttttttttttttttttttttttttttttcttttccttttttttttttctctttcttggtggctccatcttagccctagtcacggctagctgtgaaaggtccgtgagccgcatgactgcagagagtgccgtaactggtctctctgcagatcatgt

SEQ ID NO: 67 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 68 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 69 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 70 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 71 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDFSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVAAYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 72 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDFSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVAAYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 73 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDFSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVAAYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 74 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 75 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVAAYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 76 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDFSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 77 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 78 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDFSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVAAYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 79 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVAAYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 80 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDFSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 81 - protein, 3033 aa, Artificial Sequence; identical to SEQ ID NO: 74
  Plasmid

SEQ ID NO: 82 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIYHSVSRARPRLLLFGLLLLFVGVGLFLLPAR

SEQ ID NO: 83 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 84 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIYHSVSRARPRLLLFGLLLLFVGVGLFLLPAR

SEQ ID NO: 85 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSMHTYTHHELTRVASALRKLGAPPLRAWKSRARAVRASLISRGGKAAVCGRYLFNWAVKTKLKLTPLPEARLLDLSSWFTVGAGGGDIFHSVSRARPRLLLFGLLLLFVGVGLFLLPAR

SEQ ID NO: 86 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSLHTYTPHELTRVASALRKLGAPPLRAWKSRARAVRASLISRGGRAAVCGRYLFNWAVKTKLKLTPLPEARLLDLSSWFTVGAGGGDIFHSVSRARPRLLLFGLLLLFVGVGLFLLPAR

SEQ ID NO: 87 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSLHTYTPHELTRVASALRKLGAPPLRAWKSRARAVRASLISRGGRAAVCGRYLFNWAVKTKLKLTPLPEARLLDLSSWFTVGAGGGDIFHSVSRARPRLLLFGLLLLFVGVGLFLLPAR

SEQ ID NO: 88 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDFSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVAAYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSLHTYTPHELTRVASALRKLGAPPLRAWKSRARAVRASLISRGGRAAVCGRYLFNWAVKTKLKLTPLPEARLLDLSSWFTVGAGGGDIFHSVSRARPRLLLFGLLLLFVGVGLFLLPAR

SEQ ID NO: 89 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDFSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVAAYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSMHTYTHHELTRVASALRKLGAPPLRAWKSRARAVRASLISRGGKAAVCGRYLFNWAVKTKLKLTPLPEARLLDLSSWFTVGAGGGDIFHSVSRARPRLLLFGLLLLFVGVGLFLLPAR

SEQ ID NO: 90 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDFSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVAAYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSLHTYTPHELTRVASALRKLGAPPLRAWKSRARAVRASLISRGGRAAVCGRYLFNWAVKTKLKLTPLPEARLLDLSSWFTVGAGGGDIYHSVSRARPRLLLFGLLLLFVGVGLFLLPAR

SEQ ID NO: 91 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSLHTYTPHELTRVASALRKLGAPPLRAWKSRARAVRASLISRGGRAAVCGRYLFNWAVKTKLKLTPLPEARLLDLSSWFTVGAGGGGIYHSVSRARPRLLLFGLLLLFVGVGLFLLPAR

SEQ ID NO: 92 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSLHTYTPHELTRVASALRKLGAPPLRAWKSRARAVRASLISRGGRAAVCGRYLFNWAVKTKLKLTPLPEARLLDLSSWFTVGAGGGGIFHSVSRARPRLLLFGLLLLFVGVGLFLLPAR

SEQ ID NO: 93 - protein, 3033 aa, Artificial Sequence; identical to SEQ ID NO: 91
  Plasmid

SEQ ID NO: 94 - protein, 3033 aa, Artificial Sequence; identical to SEQ ID NO: 92
  Plasmid

SEQ ID NO: 95 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSLHTYTPHELTRVASALRKLGAPPLRAWKSRARAVRASLISRGGRAAVCGRYLFNWAVKTKLKLTPLPEARLLDLSSWFTVGAGGGGIYHSVSRARPRLLLFGLLLLFVGVGLFLLPAR

SEQ ID NO: 96 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGLVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSLHTYTPHELTRVASALRKLGAPPLRAWKSRARAVRASLISRGGRAAVCGRYLFNWAVKTKLKLTPLPEARLLDLSSWFTVGAGGGGIYHSVSRARPRLLLFGLLLLFVGVGLFLLPAR

SEQ ID NO: 97 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGSHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSLHTYTPHELTRVASALRKLGAPPLRAWKSRARAVRASLISRGGRAAVCGRYLFNWAVKTKLKLTPLPEARLLDLSSWFTVGAGGGGIYHSVSRARPRLLLFGLLLLFVGVGLFLLPAR

SEQ ID NO: 98 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGTHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSLHTYTPHELTRVASALRKLGAPPLRAWKSRARAVRASLISRGGRAAVCGRYLFNWAVKTKLKLTPLPEARLLDLSSWFTVGAGGGGIYHSVSRARPRLLLFGLLLLFVGVGLFLLPAR

SEQ ID NO: 99 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGLVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSLHTYTPHELTRVASALRKLGAPPLRAWKSRARAVRASLISRGGRAAVCGRYLFNWAVKTKLKLTPLPEARLLDLSSWFTVGAGGGGIYHSVSRARPRLLLFGLLLLFVGVGLFLLPAR

SEQ ID NO: 100 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGSHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSLHTYTPHELTRVASALRKLGAPPLRAWKSRARAVRASLISRGGRAAVCGRYLFNWAVKTKLKLTPLPEARLLDLSSWFTVGAGGGGIYHSVSRARPRLLLFGLLLLFVGVGLFLLPAR

SEQ ID NO: 101 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGTHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSLHTYTPHELTRVASALRKLGAPPLRAWKSRARAVRASLISRGGRAAVCGRYLFNWAVKTKLKLTPLPEARLLDLSSWFTVGAGGGGIYHSVSRARPRLLLFGLLLLFVGVGLFLLPAR

SEQ ID NO: 102 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGLVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGSHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSLHTYTPHELTRVASALRKLGAPPLRAWKSRARAVRASLISRGGRAAVCGRYLFNWAVKTKLKLTPLPEARLLDLSSWFTVGAGGGGIYHSVSRARPRLLLFGLLLLFVGVGLFLLPAR

SEQ ID NO: 103 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGLVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGTHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSLHTYTPHELTRVASALRKLGAPPLRAWKSRARAVRASLISRGGRAAVCGRYLFNWAVKTKLKLTPLPEARLLDLSSWFTVGAGGGGIYHSVSRARPRLLLFGLLLLFVGVGLFLLPAR

SEQ ID NO: 104 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGLVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGSHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSLHTYTPHELTRVASALRKLGAPPLRAWKSRARAVRASLISRGGRAAVCGRYLFNWAVKTKLKLTPLPEARLLDLSSWFTVGAGGGGIYHSVSRARPRLLLFGLLLLFVGVGLFLLPAR

SEQ ID NO: 105 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGTIVVSMTGRDKTEQAGEIQVLSTVTQSFLGTSISGVLWTVYHGAGNKTLAGSRGLVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGAPITYSTYGKFLADGGCAGGAYDIIICDECHAVDSTTILGIGTVLDQAETAGVRLTVLATATPPGSVTTPHPNIEEVALGQEGEIPFYGRAIPLSYIKGGRHLIFCHSKKKCDELAAALRGMGLNSVAYYRGLDVSVIPTQGDVVVVATDALMTGYTGDFDSVIDCNVAVTQVVDLSLDPTFTITTQIVPQDAVSRSQRRGRTGRGRLGIYRYVSTGERASGMFDSVVLCECYDAGAAWYELTPSETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVASYCLATGCVCIIGRLHINQRAVVAPDKEVLYEAFDEMEECASRAALIEEGQRIAEMLKSKIQGLLQQASKQAQDIQPTVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGTHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTTKSASLRAKKVTFDRMQVLDSYYDSVLKDIKLAASKVTARLLTMEEACQLTPPHSARSKYGFGAKEVRSLSGRAVNHIKSVWKDLLEDSETPIPTTIMAKNEVFCVDPTKGGKKAARLIVYPDLGVRVCEKMALYDITQKLPQAVMGASYGFQYSPAQRVEFLLKAWAEKKDPMGFSYDTRCFDSTVTERDIRTEESIYRACSLPEEAHTAIHSLTERLYVGGPMFNSKGQTCGYRRCRASGVLTTSMGNTITCYVKALAACKAAGIIAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWARMVLMTHFFSILMAQDTLDQNLNFEMYGAVYSVSPLDLPAIIERLHGLDAFSLHTYTPHELTRVASALRKLGAPPLRAWKSRARAVRASLISRGGRAAVCGRYLFNWAVKTKLKLTPLPEARLLDLSSWFTVGAGGGGIYHSVSRARPRLLLFGLLLLFVGVGLFLLPAR

SEQ ID NO: 106 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWFFIFFTAAWYLKGRVVPVATYSVLGLWSFLLLVLALPQQAYALDAAEQGELGLAILVIISIFTLTPAYKILLSRSVWWLSYMLVLAEAQIQQWVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVATRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDFSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVAAYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWITEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVEDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPHELSRVAATLRKLGAPPLRAWKSRARAVRASLIAQGARAAICGRYLFNWAVKTKLKLTPLPEASRLDLSGWFTVGAGGGDIYHSVSHARPRLLLLCLLLLSVGVGIFLLPAR

SEQ ID NO: 107 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWFFIFFTAAWYLKGRVVPVATYSVLGLWSFLLLVLALPQQAYALDAAEQGELGLAILVIISIFTLTPAYKILLSRSVWWLSYMLVLAEAQIQQWVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVATRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWITEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVEDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPHELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 108 - protein, 3066 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWFFIFFTAAWYLKGRVVPVATYSVLGLWSFLLLVLALPQQAYALDAAEQGELGLAILVIISIFTLTPAYKILLSRSVWWLSYMLVLAEAQIQQWVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVATRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWITEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVEDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPHELSRVAATLRKLGAPPLRAWKSRARAVRASLIAQGARAAICGRYLFNWAVKTKLKLTPLPEASRLDLSGWFTVGAGGGGIFHSVSHARPRLLLLCLLLLSVGVGIFLLPARGIFHSVSHARPRLLLLCLLLLSVGVGIFLLPAR

SEQ ID NO: 109 - protein, 3066 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWFFIFFTAAWYLKGRVVPVATYSVLGLWSFLLLVLALPQQAYALDAAEQGELGLAILVIISIFTLTPAYKILLSRSVWWLSYMLVLAEAQIQQWVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVATRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWITEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVEDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPARGIYHSVSHARPRLLLLCLLLLSVGVGIFLLPAR

SEQ ID NO: 110 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWCFIFFTAAWYLKGRVVPVATYSVLGLWSFLLLVLALPQQAYALDAAEQGELGLAILVIISIFTLTPAYKILLSRSVWWLSYMLVLAEAQIQQWVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVATRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWITEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVEDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 111 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWFFIFFTAAWYLKGRVVPVATYSVLGLWSFLLLVLALPQQAYALDAAEQGELGLAILVIISIFTLTPAYKILLSRSVWWLSYMLVLAEAQIQQWVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVTTRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWITEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVEDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 112 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWFFIFFTAAWYLKGRVVPVATYSVLGLWSFLLLVLALPQQAYALDAAEQGELGLAILVIISIFTLTPAYKILLSRSVWWLSYMLVLAEAQIQQWVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVATRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWVTEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVEDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 113 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWFFIFFTAAWYLKGRVVPVATYSVLGLWSFLLLVLALPQQAYALDAAEQGELGLAILVIISIFTLTPAYKILLSRSVWWLSYMLVLAEAQIQQWVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVATRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWITEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVEDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVSPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 114 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWFFIFFTAAWYLKGRVVPVATYSVLGLWSFLLLVLALPQQAYALDAAEQGELGLAILVIISIFTLTPAYKILLSRSVWWLSYMLVLAEAQIQQRVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVATRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWITEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVEDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 115 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWFFIFFTAAWYLKGRVVPVATYSVLGLWSFLLLVLALPQQAYALDAAEQGELGLAILVIISIFTLTPAYKILLSRSVWWLSYMLVLAEAQIQQWVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVATRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWITEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVVDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 116 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWCFIFFTAAWYLKGRVVPVATYSVLGLWSFLLLVLALPQQAYALDAAEQGELGLAILVIISIFTLTPAYKILLSRSVWWLSYMLVLAEAQIQQWVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVATRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWITEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVEDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVSPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 117 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWCFIFFTAAWYLKGRVVPVATYSVLGLWSFLLLVLALPQQAYALDAAEQGELGLAILVIISIFTLTPAYKILLSRSVWWLSYMLVLAEAQIQQWVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVTTRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWITEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVEDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 118 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWCFIFFTAAWYLKGRVVPVATYSVLGLWSFLLLVLALPQQAYALDAAEQGELGLAILVIISIFTLTPAYKILLSRSVWWLSYMLVLAEAQIQQRVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVATRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWITEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVEDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 119 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWCFIFFTAAWYLKGRVVPVATYSVLGLWSFLLLVLALPQQAYALDAAEQGELGLAILVIISIFTLTPAYKILLSRSVWWLSYMLVLAEAQIQQWVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVTTRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWVTEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVEDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 120 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWCFIFFTAAWYLKGRVVPVATYSVLGLWSFLLLVLALPQQAYALDAAEQGELGLAILVIISIFTLTPAYKILLSRSVWWLSYMLVLAEAQIQQWVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVTTRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWVTEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVEDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVSPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 121 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWCFIFFTAAWYLKGRVVPVATYSVLGLWSFLLLVLALPQQAYALDAAEQGELGLAILVIISIFTLTPAYKILLSRSVWWLSYMLVLAEAQIQQRVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVATRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWITEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVVDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 122 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWCFIFFTAAWYLKGRVVPVATYSVLGLWSFLLLVLALPQQAYALDAAEQGELGLAILVIISIFTLTPAYKILLSRSVWWLSYMLVLAEAQIQQRVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVTTRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWVTEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVVDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 123 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWCFIFFTAAWYLKGRVVPVATYSVLGLWSFLLLVLALPQQAYALDAAEQGELGLAILVIISIFTLTPAYKILLSRSVWWLSYMLVLAEAQIQQWVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVATRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWITEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVVDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 124 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWCFIFFTAAWYLKGRVVPVATYSVLGLWSFLLLVLALPQQAYALDAAEQGELGLAILVIISIFTLTPAYKILLSRSVWWLSYMLVLAEAQIQQWVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVATRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWVTEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVVDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 125 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWFFIFFTAAWYLKGRVVPVATYSVLGLWSFLLLVLALPQQAYALDAAEQGELGLAILVIISIFTLTPAYKILLSRSVWWLSYMLVLAEAQIQQWVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVATRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWVTEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVVDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 126 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWCFIFFTAAWYLKGRVVPVATYSVLGLWSFLLLVLALPQQAYALDAAEQGELGLAILVIISIFTLTPAYKILLSRSVWWLSYMLVLAEAQIQQWVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVTTRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWVTEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVVDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 127 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWCFIFFTAAWYLKGRVVPVATYSVLGLWSFLLLVLALPQQAYALDAAEQGELGLAILVIISIFTLTPAYKILLSRSVWWLSYMLVLAEAQIQQRVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVTTRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWVTEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVEDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 128 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWCFIFFTAAWYLKGRVVPVATYSVLGLWSFLLLVLALPQQAYALDAAEQGELGLAILVIISIFTLTPAYKILLSRSVWWLSYMLVLAEAQIQQRVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVATRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWVTEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVVDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 129 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWCFIFFTAAWYLKGRVVPVATYSVLGLWSFLLLVLALPQQAYALDAAEQGELGLAILVIISIFTLTPAYKILLSRSVWWLSYMLVLAEAQIQQRVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVATRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWVTEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVEDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 130 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWCFIFFTAAWYLKGRVVPVATYSVLGLWSFLLLVLALPQQAYALDAAEQGELGLAILVIISIFTLTPAYKILLSRSVWWLSYMLVLAEAQIQQRVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVTTRTPSFSDNSTPPAVPQSYQVGYLHAPTGSGKSTKVPAAYASQGYKVLVLNPSVAATLGFGAYMSKAHGINPNIRTGVRTVTTGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWVTEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVVDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVSPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 131 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWCFIFFTAAWYLKGRVVPVATYSVLGLWSFLLLVLALPQQAYALDAAEQGELGLAILVIISIFTLTPAYKILLSRSVWWLSYMLVLAEAQIQQRVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVTTRTPSFSDNSTPPAVPQSYQVGYLHAPTGSGKSTKVPAAYASQGYKVLVLNPSVAATLGFGAYMSKAHGINPNIRTGVRTVATGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWVTEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVEDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 132 - protein, 3033 aa, Artificial Sequence
  Plasmid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLNWSPTLAMILAYAARVPEMVLEIIFGGHWGVVFGLAYFSMQGAWAKVIAILLLVAGVDATTYSSGQEAGRTVLGFTNLFTSGAKQNLYLINTNGSWHINRTALNCNDSLQTGFMASLFYTHRFNSSGCPERLSSCRGLDDFRIGWGTLEYETHVTNDEDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEAALEKLIILHSASAASANGPLWCFIFFTAAWYLKGRVVPVATYSVLGLWSFLLLVLALPQQAYALDAAEQGELGLAILVIISIFTLTPAYKILLSRSVWWLSYMLVLAEAQIQQRVPPLEVRGGRDGIIWVAVILHPRLVFEVTKWLLAILGPAYLLKASLLRIPYFVRAHALLRVCTLVKHLAGARYIQMLLITIGRWTGTYIYDHLSPLSTWAAQGLRDLAIAVEPVVFSPMEKKVIVWGAETVACGDILHGLPVSARLGREVLLGPADGYTSKGWKLLAPITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVTTRTPSFSDNSTPPAVPQSYQVGYLHAPTGSGKSTKVPAAYASQGYKVLVLNPSVAATLGFGAYMSKAHGINPNIRTGVRTVATGDSITYSTYGKFIADGGCAAGAYDIIICDECHSVDATTILGIGTVLDQAETAGVRLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVSQIVDLSLDPTFTITTQIVPQDAVSRSQRRGRTGRGRLGVYRYVSSGERPSGMFDSVVLCECYDAGAAWYELTPAETTVRLRAYFNTPGLPVCQDHLEFWEAVFTGLTHIDAHFLSQTKQGGENFAYLTAYQATVCARAKAPPPSWDVMWKCLTRLKPTLTGPTPLLYRLGAVTNEVTLTHPVTKYIATCMQADLEIMTSSWVLAGGVLAAVASYCLATGCISIIGRLHLNDRVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPTVEDVVNLLPAILSPGALVVGVICAAILRRHVGQGEGAVQWMNRLIAFASRGNHVAPTHYVVESDASQRVTQVLSSLTITSLLRRLHAWVTEDCPVPCSGSWLQDIWDWVCSILTDFKNWLSSKLLPKMPGIPFISCQKGYKGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPVPGPFFRDEVTFTVGLNSFVVGSQLPCDPEPDTEVLASMLTDPSHITAEAAARRLARGSPPSQASSSASQLSAPSLKATCTTHKTAYDCDMVDANLFMGGDVTRIESDSKVIVLDSLDSMTEVVDDREPSVPSEYLIKRRKFPPALPPWARPDYNPVLIETWKRPGYEPPTVLGCALPPTPQTPVPPPRRRRAKVLTQDNVEGILREMADKVLSPLQDNNDSGHSTGADTGGDIVQQPSDETAASEAGSLSSMPPLEGEPGDPDLEFEPVGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLTVEEACALTPPHSAKSRYGFGAKEVRSLSRRAVNHIRSVWEDLLEDQHTPIDTTIMAKNEVFCIDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPVMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVSPLDLPAIIERLHGLEAFSLHTYSPRELSRVAATLRKLGAPPLRAWKSRARAVRASLIAQGARAAICGRYLFNWAVKTKLKLTPLPEASRLDLSGWFTVGAGGGGIYHSVSHARPRLLLLCLLLLSVGVGIFLLPAR

SEQ ID NO: 133 - DNA, 9613 bp, Artificial Sequence
  plasmid
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggcgcccatcacggcgtacgcccagcaaacgaggggcctcctagggtgtataatcaccagtctgaccggccgggacaaaaaccaagtggagggtgagatccagattgtgtcaactgctgcccaaaccttcctggcaacgtgcatcaacggggtttgctggaccgtctaccacggggccggaacgaggaccatcgcatcacccaagggtccggttatccaaatgtataccaatgtggacaaagaccttgtgggctggcccgctcctcaaggtgcccgctcactgacaccctgtacctgcggctcctcggacctttacctggtcacgaggcacgccgatgtcattcccgtgcgccggcggggtgatagcaggggcagcctgctttcgccccggcccatttcctacttgaaaggctcctcggggggtccgctgctgtgccccgcgggacacgccgtaggcttattcagggccgcggtgtgcacccgtggagtggctaaggcggtggacttcatccctgtggagaacctagagacaaccatgaggtccccggtgttcacggacaactcctctccaccagcagtgccccagagcttccaggtggcccacctgcatgctcccaccggcagcggcaaaagcaccaaggtcccggctgcatacgcagctcagggctataaggtgctagtgctcaacccctctgtcgctgcaacactgggctttggtgcttacatgtccaaggcccatggggtcgatcctaatatcaggaccggggtgagaacaattaccactggcagccccatcacgtactccacctacggcaagttccttgccgacggcgggtgttcagggggtgcttatgacataataatttgtgacgagtgccactccacggatgccacatccatcttgggcatcggcaccgttcttgaccaagcagagaccgcgggggcgagactggttgtgctcgccaccgctacccctccgggctccatcaccgtgccccatcctaacatcgaggaggttgctctgtccactaccggagagatccctttttacggcaaggctatccccctcgaggcgatcaagggggggagacatctcatcttctgtcactcaaagaagaagtgcgacgagctcgccgcaaagctggtcgcattgggcatcaatgccgtggcctactaccgcggtcttgacgtgtctgtcatcccaaccagcggcgatgttgtcgtcgtggcgaccgatgctcttatgactggctataccggcgactttgactcggtgatagactgcaacacgtgtgtcacccagacagtcgacttcagccttgaccctaccttcaccattgagacgaccacgctcccccaggacgctgtctcccgcacacaacgccggggcaggactggcagggggaagccaggcatctacagattcgtggcactgggggagcgcccctccggcatgttcgactcgtccgttctctgtgagtgctatgacgcgggctgtgcttggtatgagctcacgcccgccgagactacagttagactacgagcgtacatgaacaccccggggctccctgtgtgccaggaccatcttgaattttgggagggcgtctttacaggcctcacccatatagatgcccatttcctatctcagacaaagcagagcggggaaaactttccttacctggtagcataccaagcaaccgtgtgcgctagggctcaagcccctcccccatcgtgggaccagatgtggaagtgtttgactcgcctcaagcccaccctccatgggccaacacccttgctatacagactgggcgctgttcagaatgaagtcaccctgacgcacccaatcaccaaatacatcatgacatgcatgtcggccgacctggaggtcgtcacgagcacctgggtgctcgtcggcggcgtcctggccgctttggccgcgtattgcctgtcaacaggctgcgtggtcatagtgggcaggattgtcctgtctgggaagccggcaattatacctgacagggaagttctctaccgggagttcgatgagatggaagagtgctctcagcacttaccgtacatcgagcaagggatgatgctcgccgagcagttcaagcagaaggccctcggcctcctgcagaccgcgtcccgtcaggcagaggttgtcgcccctgctgtccagaccaactggcaaaaactcgaggccttctgggcgaagcatatgtggaacttcatcagtgggatacaatacttggcgggcttgtcaacgttgcctggtaaccccgccattgcttcattgatggcttttacagctgctgtcaccagcccactaaccactagccaaaccctcctcttcaacatactgggggggtgggtggctgcccagcttgccgcccccggtgccgccaccgcctttgtgggcgctggcttagccggcgccgcaatcggcagtgttggactggggaaggtcctcgtggacattctagcagggtatggcgcgggcgtggcgggagctcttgtagcattcaagatcatgagcggtgaggtcccctccacggaggacctagtcaacctgctgcccgccatcctctcgcctggagcccttgtagtcggtgtggtctgcgcagcaatactgcgccggcacgtcggcccgggcgagggggcagtgcaatggatgaaccggctaatcgccttcgcctcccgggggaaccatgtttcccccacgcactatgtgccggagagcgatgcagctgcccgcgtcactaccatactcagcagcctcactgtaacccagctcctgaggcgactgcaccagtggataagctcggagtgtaccactccatgctccggttcctggctgagggacatctgggactggatatgcgaggtgctgagcgactttaagacctggctgaaagccaagctcatgccgcaactgcctgggattccctttgtgtcctgccagcgtgggtataagggggtctggcgaggggacggcatcatgcacactcgctgccactgtggagctgagataactggacatgtcaaaaacgggacgatgaggatcgttggtcctaagacttgcaggaacatgtggagtgggactttccccattaacgcctacaccacgggcccctgtactccccttcctgcgccgaactatacgttcgcgctgtggagggtgtctgcagaggaatacgtggagataaggcaggtgggggacttccactacgtgacgggtatgactactgacaaccttaaatgcccgtgccaggtcccatcgcccgaatttttcacagaattggacggggtgcgcctacataggtttgcgcccccttgcaagcccctgctgcgggaggaggtgtcattcagagtgggactccacgagtacccggtggggtcgcaattaccttgcgagcccgaaccggacgtggccgtgttgacgtccatgctcactgatccctcccatataacagcagaggcggccgggagaaggttggcgaggggatcacccccctctatggccagctcctcggctagccaactgtccgctccatctctcagggcaacttgcactaccaaccatgactcccctgatgctgagctcatagaggccaacctcctatggaggcaggagatgggcggcaacatcaccagggttgagtcagagaacaaagtggtgattctggactccttcgatccgcttgtggcagaggaggatgagcgggaggtctccgtgcccgcagagatactgcggaagtctcggaaattcaccccagccctacccatttgggcgcggccggactataaccccccgctggtggagccgtggaaaaagcctgactacgaaccacctgtggtccatggctgcccgcttccacctccacagtcccctcctgtgcctccacctcggaagaagcggacggtgatcctcaccgaatcaaccctacctactgccttggccgagcttgccaccaaaagttttggcagctcctcaacttccggcattacgggcgacgacacgacaacatcccctgagcccgcctcctctagctgccctcccgactccgacgctgagtcctattcttccatgccccctctggagggggagcctggggatccggatctcagcgacgggtcatggtcgacggtcagtagtgaggccgacaaggaggatgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 134 - DNA, 9613 bp, Artificial Sequence
  plasmid
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggcgcccatcacggcgtacgcccagcaaacgaggggcctcctagggtgtataatcaccagtctgaccggccgggacaaaaaccaagtggagggtgagatccagattgtgtcaactgctgcccaaaccttcctggcaacgtgcatcaacggggtttgctggaccgtctaccacggggccggaacgaggaccatcgcatcacccaagggtccggttatccaaatgtataccaatgtggacaaagaccttgtgggctggcccgctcctcaaggtgcccgctcactgacaccctgtacctgcggctcctcggacctttacctggtcacgaggcacgccgatgtcattcccgtgcgccggcggggtgatagcaggggcagcctgctttcgccccggcccatttcctacttgaaaggctcctcggggggtccgctgctgtgccccgcgggacacgccgtaggcttattcagggccgcggtgtgcacccgtggagtggctaaggcggtggacttcatccctgtggagaacctagagacaaccatgaggtccccggtgttcacggacaactcctctccaccagcagtgccccagagcttccaggtggcccacctgcatgctcccaccggcagcggcaaaagcaccaaggtcccggctgcatacgcagctcagggctataaggtgctagtgctcaacccctctgtcgctgcaacactgggctttggtgcttacatgtccaaggcccatggggtcgatcctaatatcaggaccggggtgagaacaattaccactggcagccccatcacgtactccacctacggcaagttccttgccgacggcgggtgttcagggggtgcttatgacataataatttgtgacgagtgccactccacggatgccacatccatcttgggcatcggcaccgttcttgaccaagcagagaccgcgggggcgagactggttgtgctcgccaccgctacccctccgggctccatcaccgtgccccatcctaacatcgaggaggttgctctgtccactaccggagagatccctttttacggcaaggctatccccctcgaggcgatcaagggggggagacatctcatcttctgtcactcaaagaagaagtgcgacgagctcgccgcaaagctggtcgcattgggcatcaatgccgtggcctactaccgcggtcttgacgtgtctgtcatcccaaccagcggcgatgttgtcgtcgtggcgaccgatgctcttatgactggctataccggcgactttgactcggtgatagactgcaacacgtgtgtcacccagacagtcgacctcagccttgaccctaccttcaccattgagacgaccacgctcccccaggacgctgtctcccgcacacaacgccggggcaggactggcagggggaagccaggcatctacagattcgtggcactgggggagcgcccctccggcatgttcgactcgtccgttctctgtgagtgctatgacgcgggctgtgcttggtatgagctcacgcccgccgagactacagttagactacgagcgtacatgaacaccccggggctccctgtgtgccaggaccatcttgaattttgggagggcgtctttacaggcctcacccatatagatgcccatttcctatctcagacaaagcagagcggggaaaactttccttacctggtagcataccaagcaaccgtgtgcgctagggctcaagcccctcccccatcgtgggaccagatgtggaagtgtttgactcgcctcaagcccaccctccatgggccaacacccttgctatacagactgggcgctgttcagaatgaagtcaccctgacgcacccaatcaccaaatacatcatgacatgcatgtcggccgacctggaggtcgtcacgagcacctgggtgctcgtcggcggcgtcctggccgctttggcctcgtattgcctgtcaacaggctgcgtggtcatagtgggcaggattgtcctgtctgggaagccggcaattatacctgacagggaagttctctaccgggagttcgatgagatggaagagtgctctcagcacttaccgtacatcgagcaagggatgatgctcgccgagcagttcaagcagaaggccctcggcctcctgcagaccgcgtcccgtcaggcagaggttgtcgcccctgctgtccagaccaactggcaaaaactcgaggccttctgggcgaagcatatgtggaacttcatcagtgggatacaatacttggcgggcttgtcaacgttgcctggtaaccccgccattgcttcattgatggcttttacagctgctgtcaccagcccactaaccactagccaaaccctcctcttcaacatactgggggggtgggtggctgcccagcttgccgcccccggtgccgccaccgcctttgtgggcgctggcttagccggcgccgcaatcggcagtgttggactggggaaggtcctcgtggacattctagcagggtatggcgcgggcgtggcgggagctcttgtagcattcaagatcatgagcggtgaggtcccctccacggaggacctagtcaacctgctgcccgccatcctctcgcctggagcccttgtagtcggtgtggtctgcgcagcaatactgcgccggcacgtcggcccgggcgagggggcagtgcaatggatgaaccggctaatcgccttcgcctcccgggggaaccatgtttcccccacgcactatgtgccggagagcgatgcagctgcccgcgtcactaccatactcagcagcctcactgtaacccagctcctgaggcgactgcaccagtggataagctcggagtgtaccactccatgctccggttcctggctgagggacatctgggactggatatgcgaggtgctgagcgactttaagacctggctgaaagccaagctcatgccgcaactgcctgggattccctttgtgtcctgccagcgtgggtataagggggtctggcgaggggacggcatcatgcacactcgctgccactgtggagctgagataactggacatgtcaaaaacgggacgatgaggatcgttggtcctaagacttgcaggaacatgtggagtgggactttccccattaacgcctacaccacgggcccctgtactccccttcctgcgccgaactatacgttcgcgctgtggagggtgtctgcagaggaatacgtggagataaggcaggtgggggacttccactacgtgacgggtatgactactgacaaccttaaatgcccgtgccaggtcccatcgcccgaatttttcacagaattggacggggtgcgcctacataggtttgcgcccccttgcaagcccctgctgcgggaggaggtgtcattcagagtgggactccacgagtacccggtggggtcgcaattaccttgcgagcccgaaccggacgtggccgtgttgacgtccatgctcactgatccctcccatataacagcagaggcggccgggagaaggttggcgaggggatcacccccctctatggccagctcctcggctagccaactgtccgctccatctctcagggcaacttgcactaccaaccatgactcccctgatgctgagctcatagaggccaacctcctatggaggcaggagatgggcggcaacatcaccagggttgagtcagagaacaaagtggtgattctggactccttcgatccgcttgtggcagaggaggatgagcgggaggtctccgtgcccgcagagatactgcggaagtctcggaaattcaccccagccctacccatttgggcgcggccggactataaccccccgctggtggagccgtggaaaaagcctgactacgaaccacctgtggtccatggctgcccgcttccacctccacagtcccctcctgtgcctccacctcggaagaagcggacggtgatcctcaccgaatcaaccctacctactgccttggccgagcttgccaccaaaagttttggcagctcctcaacttccggcattacgggcgacgacacgacaacatcccctgagcccgcctcctctagctgccctcccgactccgacgctgagtcctattcttccatgccccctctggagggggagcctggggatccggatctcagcgacgggtcatggtcgacggtcagtagtgaggccgacaaggaggatgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcggcatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 135 - DNA, 9613 bp, Artificial Sequence
  plasmid
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggcgcccatcacggcgtacgcccagcaaacgaggggcctcctagggtgtataatcaccagtctgaccggccgggacaaaaaccaagtggagggtgagatccagattgtgtcaactgctgcccaaaccttcctggcaacgtgcatcaacggggtttgctggaccgtctaccacggggccggaacgaggaccatcgcatcacccaagggtccggttatccaaatgtataccaatgtggacaaagaccttgtgggctggcccgctcctcaaggtgcccgctcactgacaccctgtacctgcggctcctcggacctttacctggtcacgaggcacgccgatgtcattcccgtgcgccggcggggtgatagcaggggcagcctgctttcgccccggcccatttcctacttgaaaggctcctcggggggtccgctgctgtgccccgcgggacacgccgtaggcttattcagggccgcggtgtgcacccgtggagtggctaaggcggtggacttcatccctgtggagaacctagagacaaccatgaggtccccggtgttcacggacaactcctctccaccagcagtgccccagagcttccaggtgggccacctgcatgctcccaccggcagcggcaaaagcaccaaggtcccggctgcatacgcagctcagggctataaggtgctagtgctcaacccctctgtcgctgcaacactgggctttggtgcttacatgtccaaggcccatggggtcgatcctaatatcaggaccggggtgagaacaattaccactggcagccccatcacgtactccacctacggcaagttccttgccgacggcgggtgttcagggggtgcttatgacataataatttgtgacgagtgccactccacggatgccacatccatcttgggcatcggcaccgttcttgaccaagcagagaccgcgggggcgagactggttgtgctcgccaccgctacccctccgggctccatcaccgtgccccatcctaacatcgaggaggttgctctgtccactaccggagagatccctttttacggcaaggctatccccctcgaggcgatcaagggggggagacatctcatcttctgtcactcaaagaagaagtgcgacgagctcgccgcaaagctggtcgcattgggcatcaatgccgtggcctactaccgcggtcttgacgtgtctgtcatcccaaccagcggcgatgttgtcgtcgtggcgaccgatgctcttatgactggctataccggcgactttgactcggtgatagactgcaacacgtgtgtcacccagacagtcgacctcagccttgaccctaccttcaccattgagacgaccacgctcccccaggacgctgtctcccgcacacaacgccggggcaggactggcagggggaagccaggcatctacagattcgtggcactgggggagcgcccctccggcatgttcgactcgtccgttctctgtgagtgctatgacgcgggctgtgcttggtatgagctcacgcccgccgagactacagttagactacgagcgtacatgaacaccccggggctccctgtgtgccaggaccatcttgaattttgggagggcgtctttacaggcctcacccatatagatgcccatttcctatctcagacaaagcagagcggggaaaactttccttacctggtagcataccaagcaaccgtgtgcgctagggctcaagcccctcccccatcgtgggaccagatgtggaagtgtttgactcgcctcaagcccaccctccatgggccaacacccttgctatacagactgggcgctgttcagaatgaagtcaccctgacgcacccaatcaccaaatacatcatgacatgcatgtcggccgacctggaggtcgtcacgagcacctgggtgctcgtcggcggcgtcctggccgctttggcctcgtattgcctgtcaacaggctgcgtggtcatagtgggcaggattgtcctgtctgggaagccggcaattatacctgacagggaagttctctaccgggagttcgatgagatggaagagtgctctcagcacttaccgtacatcgagcaagggatgatgctcgccgagcagttcaagcagaaggccctcggcctcctgcagaccgcgtcccgtcaggcagaggttgtcgcccctgctgtccagaccaactggcaaaaactcgaggccttctgggcgaagcatatgtggaacttcatcagtgggatacactacttggcgggcttgtcaacgttgcctggtaaccccgccattgcttcattgatggcttttacagctgctgtcaccagcccactaaccactagccaaaccctcctcttcaacatactgggggggtgggtggctgcccagcttgccgcccccggtgccgccaccgcctttgtgggcgctggcttagccggcgccgcaatcggcagtgttggactggggaaggtcctcgtggacattctagcagggtatggcgcgggcgtggcgggagctcttgtagcattcaagatcatgagcggtgaggtcccctccacggaggacctagtcaacctgctgcccgccatcctctcgcctggagcccttgtagtcggtgtggtctgcgcagcaatactgcgccggcacgtcggcccgggcgagggggcagtgcaatggatgaaccggctaatcgccttcgcctcccgggggaaccatgtttcccccacgcactatgtgccggagagcgatgcagctgcccgcgtcactaccatactcagcagcctcactgtaacccagctcctgaggcgactgcaccagtggataagctcggagtgtaccactccatgctccggttcctggctgagggacatctgggactggatatgcgaggtgctgagcgactttaagacctggctgaaagccaagctcatgccgcaactgcctgggattccctttgtgtcctgccagcgtgggtataagggggtctggcgaggggacggcatcatgcacactcgctgccactgtggagctgagataactggacatgtcaaaaacgggacgatgaggatcgttggtcctaagacttgcaggaacatgtggagtgggactttccccattaacgcctacaccacgggcccctgtactccccttcctgcgccgaactatacgttcgcgctgtggagggtgtctgcagaggaatacgtggagataaggcaggtgggggacttccactacgtgacgggtatgactactgacaaccttaaatgcccgtgccaggtcccatcgcccgaatttttcacagaattggacggggtgcgcctacataggtttgcgcccccttgcaagcccctgctgcgggaggaggtgtcattcagagtgggactccacgagtacccggtggggtcgcaattaccttgcgagcccgaaccggacgtggccgtgttgacgtccatgctcactgatccctcccatataacagcagaggcggccgggagaaggttggcgaggggatcacccccctctatggccagctcctcggctagccaactgtccgctccatctctcagggcaacttgcactaccaaccatgactcccctgatgctgagctcatagaggccaacctcctatggaggcaggagatgggcggcaacatcaccagggttgagtcagagaacaaagtggtgattctggactccttcgatccgcttgtggcagaggaggatgagcgggaggtctccgtgcccgcagagatactgcggaagtctcggaaattcaccccagccctacccatttgggcgcggccggactataaccccccgctggtggagccgtggaaaaagcctgactacgaaccacctgtggtccatggctgcccgcttccacctccacagtcccctcctgtgcctccacctcggaagaagcggacggtgatcctcaccgaatcaaccctacctactgccttggccgagcttgccaccaaaagttttggcagctcctcaacttccggcattacgggcgacgacacgacaacatcccctgagcccgcctcctctagctgccctcccgactccgacgctgagtcctattcttccatgccccctctggagggggagcctggggatccggatctcagcgacgggtcatggtcgacggtcagtagtgaggccgacaaggaggatgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcggcatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 136 - DNA, 9613 bp, Artificial Sequence
  plasmid
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggcgcccatcacggcgtacgcccagcaaacgaggggcctcctagggtgtataatcaccagtctgaccggccgggacaaaaaccaagtggagggtgagatccagattgtgtcaactgctgcccaaaccttcctggcaacgtgcatcaacggggtttgctggaccgtctaccacggggccggaacgaggaccatcgcatcacccaagggtccggttatccaaatgtataccaatgtggacaaagaccttgtgggctggcccgctcctcaaggtgcccgctcactgacaccctgtacctgcggctcctcggacctttacctggtcacgaggcacgccgatgtcattcccgtgcgccggcggggtgatagcaggggcagcctgctttcgccccggcccatttcctacttgaaaggctcctcggggggtccgctgctgtgccccgcgggacacgccgtaggcttattcagggccgcggtgtgcacccgtggagtggctaaggcggtggacttcatccctgtggagaacctagagacaaccatgaggtccccggtgttcacggacaactcctctccaccagcagtgccccagagcttccaggtgggccacctgcatgctcccaccggcagcggcaaaagcaccaaggtcccggctgcatacgcagctcagggctataaggtgctagtgctcaacccctctgtcgctgcaacactgggctttggtgcttacatgtccaaggcccatggggtcgatcctaatatcaggaccggggtgagaacaattaccactggcagccccatcacgtactccacctacggcaagttccttgccgacggcgggtgttcagggggtgcttatgacataataatttgtgacgagtgccactccacggatgccacatccatcttgggcatcggcaccgttcttgaccaagcagagaccgcgggggcgagactggttgtgctcgccaccgctacccctccgggctccatcaccgtgccccatcctaacatcgaggaggttgctctgtccactaccggagagatccctttttacggcaaggctatccccctcgaggcgatcaagggggggagacatctcatcttctgtcactcaaagaagaagtgcgacgagctcgccgcaaagctggtcgcattgggcatcaatgccgtggcctactaccgcggtcttgacgtgtctgtcatcccaaccagcggcgatgttgtcgtcgtggcgaccgatgctcttatgactggctataccggcgactttgactcggtgatagactgcaacacgtgtgtcacccagacagtcgacctcagccttgaccctaccttcaccattgagacgaccacgctcccccaggacgctgtctcccgcacacaacgccggggcaggactggcagggggaagccaggcatctacagattcgtggcactgggggagcgcccctccggcatgttcgactcgtccgttctctgtgagtgctatgacgcgggctgtgcttggtatgagctcacgcccgccgagactacagttagactacgagcgtacatgaacaccccggggctccctgtgtgccaggaccatcttgaattttgggagggcgtctttacaggcctcacccatatagatgcccatttcctatctcagacaaagcagagcggggaaaactttccttacctggtagcataccaagcaaccgtgtgcgctagggctcaagcccctcccccatcgtgggaccagatgtggaagtgtttgactcgcctcaagcccaccctccatgggccaacacccttgctatacagactgggcgctgttcagaatgaagtcaccctgacgcacccaatcaccaaatacatcatgacatgcatgtcggccgacctggaggtcgtcacgagcacctgggtgctcgtcggcggcgtcctggccgctttggcctcgtattgcctgtcaacaggctgcgtggtcatagtgggcaggattgtcctgtctgggaagccggcaattatacctgacagggaagttctctaccgggagttcgatgagatggaagagtgctctcagcacttaccgtacatcgagcaagggatgatgctcgccgagcagttcaagcagaaggccctcggcctcctgcagaccgcgtcccgtcaggcagaggttgtcgcccctgctgtccagaccaactggcaaaaactcgaggccttctgggcgaagcatatgtggaacttcatcagtgggatacaatacttggcgggcttgtcaacgttgcctggtaaccccgccattgcttcattgatggcttttacagctgctgtcaccagcccactaaccactagccaaaccctcctcttcaacatactgggggggtgggtggctgcccagcttgccgcccccggtgccgccaccgcctttgtgggcgctggcttagccggcgccgcaatcggcagtgttggactggggaaggtcctcgtggacattctagcagggtatggcgcgggcgtggcgggagctcttgtagcattcaagatcatgagcggtgaggtcccctccacggaggacctagtcaacctgctgcccgccatcctctcgcctggagcccttgtagtcggtgtggtctgcgcagcaatactgcgccggcacgtcggcccgggcgagggggcagtgcaatggatgaaccggctaatcgccttcgcctcccgggggaaccatgtttcccccacgcactatgtgccggagagcgatgcagctgcccgcgtcactaccatactcagcagcctcactgtaacccagctcctgaggcgactgcaccagtggataagctcggagtgtaccactccatgctccggttcctggctgagggacatctgggactggatatgcgaggtgctgagcgactttaagacctggctgaaagccaagctcatgccgcaactgcctgggattccctttgtgtcctgccagcgtgggtataagggggtctggcgaggggacggcatcatgcacactcgctgccactgtggagctgagataactggacatgtcaaaaacgggacgatgaggatcgttggtcctaagacttgcaggaacatgtggagtgggactttccccattaacgcctacaccacgggcccctgtactccccttcctgcgccgaactatacgttcgcgctgtggagggtgtctgcagaggaatacgtggagataaggcaggtgggggacttccactacgtgacgggtatgactactgacaaccttaaatgcccgtgccaggtcccatcgcccgaatttttcacagaattggacggggtgcgcctacataggtttgcgcccccttgcaagcccctgctgcgggaggaggtgtcattcagagtgggactccacgagtacccggtggggtcgcaattaccttgcgagcccgaaccggacgtggccgtgttgacgtccatgctcactgatccctcccatataacagcagaggcggccgggagaaggttggcgaggggatcacccccctctatggccagctcctcggctagccaactgtccgctccatctctcagggcaacttgcactaccaaccatgactcccctgatgctgagctcatagaggccaacctcctatggaggcaggagatgggcggcaacatcaccagggttgagtcagagaacaaagtggtgattctggactccttcgatccgcttgtggcagaggaggatgagcgggaggtctccgtgcccgcagagatactgcggaagtctcggaaattcaccccagccctacccatttgggcgcggccggactataaccccccgctggtggagccgtggaaaaagcctgactacgaaccacctgtggtccatggctgcccgcttccacctccacagtcccctcctgtgcctccacctcggaagaagcggacggtgatcctcaccgaatcaaccctacctactgccttggccgagcttgccaccaaaagttttggcagctcctcaacttccggcattacgggcgacgacacgacaacatcccctgagcccgcctcctctagctgccctcccgactccgacgctgagtcctattcttccatgccccctctggagggggagcctggggatccggatctcagcgacgggtcatggtcgacggtcagtagtgaggccgacaaggaggatgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcggcatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 137 - DNA, 9613 bp, Artificial Sequence
  plasmid
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggcgcccatcacggcgtacgcccagcaaacgaggggcctcctagggtgtataatcaccagtctgaccggccgggacaaaaaccaagtggagggtgagatccagattgtgtcaactgctgcccaaaccttcctggcaacgtgcatcaacggggtttgctggaccgtctaccacggggccggaacgaggaccatcgcatcacccaagggtccggttatccaaatgtataccaatgtggacaaagaccttgtgggctggcccgctcctcaaggtgcccgctcactgacaccctgtacctgcggctcctcggacctttacctggtcacgaggcacgccgatgtcattcccgtgcgccggcggggtgatagcaggggcagcctgctttcgccccggcccatttcctacttgaaaggctcctcggggggtccgctgctgtgccccgcgggacacgccgtaggcttattcagggccgcggtgtgcacccgtggagtggctaaggcggtggacttcatccctgtggagaacctagagacaaccatgaggtccccggtgttcacggacaactcctctccaccagcagtgccccagagcttccaggtggcccacctgcatgctcccaccggcagcggcaaaagcaccaaggtcccggctgcatacgcagctcagggctataaggtgctagtgctcaacccctctgtcgctgcaacactgggctttggtgcttacatgtccaaggcccatggggtcgatcctaatatcaggaccggggtgagaacaattaccactggcagccccatcacgtactccacctacggcaagttccttgccgacggcgggtgttcagggggtgcttatgacataataatttgtgacgagtgccactccacggatgccacatccatcttgggcatcggcaccgttcttgaccaagcagagaccgcgggggcgagactggttgtgctcgccaccgctacccctccgggctccatcaccgtgccccatcctaacatcgaggaggttgctctgtccactaccggagagatccctttttacggcaaggctatccccctcgaggcgatcaagggggggagacatctcatcttctgtcactcaaagaagaagtgcgacgagctcgccgcaaagctggtcgcattgggcatcaatgccgtggcctactaccgcggtcttgacgtgtctgtcatcccaaccagcggcgatgttgtcgtcgtggcgaccgatgctcttatgactggctataccggcgactttgactcggtgatagactgcaacacgtgtgtcacccagacagtcgacctcagccttgaccctaccttcaccattgagacgaccacgctcccccaggacgctgtctcccgcacacaacgccggggcaggactggcagggggaagccaggcatctacagattcgtggcactgggggagcgcccctccggcatgttcgactcgtccgttctctgtgagtgctatgacgcgggctgtgcttggtatgagctcacgcccgccgagactacagttagactacgagcgtacatgaacaccccggggctccctgtgtgccaggaccatcttgaattttgggagggcgtctttacaggcctcacccatatagatgcccatttcctatctcagacaaagcagagcggggaaaactttccttacctggtagcataccaagcaaccgtgtgcgctagggctcaagcccctcccccatcgtgggaccagatgtggaagtgtttgactcgcctcaagcccaccctccatgggccaacacccttgctatacagactgggcgctgttcagaatgaagtcaccctgacgcacccaatcaccaaatacatcatgacatgcatgtcggccgacctggaggtcgtcacgagcacctgggtgctcgtcggcggcgtcctggccgctttggcctcgtattgcctgtcaacaggctgcgtggtcatagtgggcaggattgtcctgtctgggaagccggcaattatacctgacagggaagttctctaccgggagttcgatgagatggaagagtgctctcagcacttaccgtacatcgagcaagggatgatgctcgccgagcagttcaagcagaaggccctcggcctcctgcagaccgcgtcccgtcaggcagaggttgtcgcccctgctgtccagaccaactggcaaaaactcgaggccttctgggcgaagcatatgtggaacttcatcagtgggatacactacttggcgggcttgtcaacgttgcctggtaaccccgccattgcttcattgatggcttttacagctgctgtcaccagcccactaaccactagccaaaccctcctcttcaacatactgggggggtgggtggctgcccagcttgccgcccccggtgccgccaccgcctttgtgggcgctggcttagccggcgccgcaatcggcagtgttggactggggaaggtcctcgtggacattctagcagggtatggcgcgggcgtggcgggagctcttgtagcattcaagatcatgagcggtgaggtcccctccacggaggacctagtcaacctgctgcccgccatcctctcgcctggagcccttgtagtcggtgtggtctgcgcagcaatactgcgccggcacgtcggcccgggcgagggggcagtgcaatggatgaaccggctaatcgccttcgcctcccgggggaaccatgtttcccccacgcactatgtgccggagagcgatgcagctgcccgcgtcactaccatactcagcagcctcactgtaacccagctcctgaggcgactgcaccagtggataagctcggagtgtaccactccatgctccggttcctggctgagggacatctgggactggatatgcgaggtgctgagcgactttaagacctggctgaaagccaagctcatgccgcaactgcctgggattccctttgtgtcctgccagcgtgggtataagggggtctggcgaggggacggcatcatgcacactcgctgccactgtggagctgagataactggacatgtcaaaaacgggacgatgaggatcgttggtcctaagacttgcaggaacatgtggagtgggactttccccattaacgcctacaccacgggcccctgtactccccttcctgcgccgaactatacgttcgcgctgtggagggtgtctgcagaggaatacgtggagataaggcaggtgggggacttccactacgtgacgggtatgactactgacaaccttaaatgcccgtgccaggtcccatcgcccgaatttttcacagaattggacggggtgcgcctacataggtttgcgcccccttgcaagcccctgctgcgggaggaggtgtcattcagagtgggactccacgagtacccggtggggtcgcaattaccttgcgagcccgaaccggacgtggccgtgttgacgtccatgctcactgatccctcccatataacagcagaggcggccgggagaaggttggcgaggggatcacccccctctatggccagctcctcggctagccaactgtccgctccatctctcagggcaacttgcactaccaaccatgactcccctgatgctgagctcatagaggccaacctcctatggaggcaggagatgggcggcaacatcaccagggttgagtcagagaacaaagtggtgattctggactccttcgatccgcttgtggcagaggaggatgagcgggaggtctccgtgcccgcagagatactgcggaagtctcggaaattcaccccagccctacccatttgggcgcggccggactataaccccccgctggtggagccgtggaaaaagcctgactacgaaccacctgtggtccatggctgcccgcttccacctccacagtcccctcctgtgcctccacctcggaagaagcggacggtgatcctcaccgaatcaaccctacctactgccttggccgagcttgccaccaaaagttttggcagctcctcaacttccggcattacgggcgacgacacgacaacatcccctgagcccgcctcctctagctgccctcccgactccgacgctgagtcctattcttccatgccccctctggagggggagcctggggatccggatctcagcgacgggtcatggtcgacggtcagtagtgaggccgacaaggaggatgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcggcatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 138 - DNA, 9599 bp, Artificial Sequence
  plasmid
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggcgcccatcacggcgtacgcccagcaaacgaggggcctcctagggtgtataatcaccagtctgaccggccgggacaaaaaccaagtggagggtgagatccagattgtgtcaactgctgcccaaaccttcctggcaacgtgcatcaacggggtttgctggaccgtctaccacggggccggaacgaggaccatcgcatcacccaagggtccggttatccaaatgtataccaatgtggacaaagaccttgtgggctggcccgctcctcaaggtgcccgctcactgacaccctgtacctgcggctcctcggacctttacctggtcacgaggcacgccgatgtcattcccgtgcgccggcggggtgatagcaggggcagcctgctttcgccccggcccatttcctacttgaaaggctcctcggggggtccgctgctgtgccccgcgggacacgccgtaggcttattcagggccgcggtgtgcacccgtggagtggctaaggcggtggacttcatccctgtggagaacctagagacaaccatgaggtccccggtgttcacggacaactcctctccaccagcagtgccccagagcttccaggtggcccacctgcatgctcccaccggcagcggcaaaagcaccaaggtcccggctgcatacgcagctcagggctataaggtgctagtgctcaacccctctgtcgctgcaacactgggctttggtgcttacatgtccaaggcccatggggtcgatcctaatatcaggaccggggtgagaacaattaccactggcagccccatcacgtactccacctacggcaagttccttgccgacggcgggtgttcagggggtgcttatgacataataatttgtgacgagtgccactccacggatgccacatccatcttgggcatcggcaccgttcttgaccaagcagagaccgcgggggcgagactggttgtgctcgccaccgctacccctccgggctccatcaccgtgccccatcctaacatcgaggaggttgctctgtccactaccggagagatccctttttacggcaaggctatccccctcgaggcgatcaagggggggagacatctcatcttctgtcactcaaagaagaagtgcgacgagctcgccgcaaagctggtcgcattgggcatcaatgccgtggcctactaccgcggtcttgacgtgtctgtcatcccaaccagcggcgatgttgtcgtcgtggcgaccgatgctcttatgactggctataccggcgactttgactcggtgatagactgcaacacgtgtgtcacccagacagtcgacctcagccttgaccctaccttcaccattgagacgaccacgctcccccaggacgctgtctcccgcacacaacgccggggcaggactggcagggggaagccaggcatctacagattcgtggcactgggggagcgcccctccggcatgttcgactcgtccgttctctgtgagtgctatgacgcgggctgtgcttggtatgagctcacgcccgccgagactacagttagactacgagcgtacatgaacaccccggggctccctgtgtgccaggaccatcttgaattttgggagggcgtctttacaggcctcacccatatagatgcccatttcctatctcagacaaagcagagcggggaaaactttccttacctggtagcataccaagcaaccgtgtgcgctagggctcaagcccctcccccatcgtgggaccagatgtggaagtgtttgactcgcctcaagcccaccctccatgggccaacacccttgctatacagactgggcgctgttcagaatgaagtcaccctgacgcacccaatcaccaaatacatcatgacatgcatgtcggccgacctggaggtcgtcacgagcacctgggtgctcgtcggcggcgtcctggccgctttggcctcgtattgcctgtcaacaggctgcgtggtcatagtgggcaggattgtcctgtctgggaagccggcaattatacctgacagggaagttctctaccgggagttcgatgagatggaagagtgctctcagcacttaccgtacatcgagcaagggatgatgctcgccgagcagttcaagcagaaggccctcggcctcctgcagaccgcgtcccgtcaggcagaggttgtcgcccctgctgtccagaccaactggcaaaaactcgaggccttctgggcgaagcatatgtggaacttcatcagtgggatacaatacttggcgggcttgtcaacgttgcctggtaaccccgccattgcttcattgatggcttttacagctgctgtcaccagcccactaaccactagccaaaccctcctcttcaacatactgggggggtgggtggctgcccagcttgccgcccccggtgccgccaccgcctttgtgggcgctggcttagccggcgccgcaatcggcagtgttggactggggaaggtcctcgtggacattctagcagggtatggcgcgggcgtggcgggagctcttgtagcattcaagatcatgagcggtgaggtcccctccacggaggacctagtcaacctgctgcccgccatcctctcgcctggagcccttgtagtcggtgtggtctgcgcagcaatactgcgccggcacgtcggcccgggcgagggggcagtgcaatggatgaaccggctaatcgccttcgcctcccgggggaaccatgtttcccccacgcactatgtgccggagagcgatgcagctgcccgcgtcactaccatactcagcagcctcactgtaacccagctcctgaggcgactgcaccagtggataagctcggagtgtaccactccatgctccggttcctggctgagggacatctgggactggatatgcgaggtgctgagcgactttaagacctggctgaaagccaagctcatgccgcaactgcctgggattccctttgtgtcctgccagcgtgggtataagggggtctggcgaggggacggcatcatgcacactcgctgccactgtggagctgagataactggacatgtcaaaaacgggacgatgaggatcgttggtcctaagacttgcaggaacatgtggagtgggactttccccattaacgcctacaccacgggcccctgtactccccttcctgcgccgaactatacgttcgcgctgtggagggtgtctgcagaggaatacgtggagataaggcaggtgggggacttccactacgtgacgggtatgactactgacaaccttaaatgcccgtgccaggtcccatcgcccgaatttttcacagaattggacggggtgcgcctacataggtttgcgcccccttgcaagcccctgctgcgggaggaggtgtcattcagagtgggactccacgagtacccggtggggtcgcaattaccttgcgagcccgaaccggacgtggccgtgttgacgtccatgctcactgatccctcccatataacagcagaggcggccgggagaaggttggcgaggggatcacccccctctatggccagctcctcggctagccaactgtccgctccatctctcagggcaacttgcactaccaaccatgactcccctgatgctgagctcatagaggccaacctcctatggaggcaggagatgggcggcaacatcaccagggttgagtcagagaacaaagtggtgattctggactccttcgatccgcttgtggcagaggaggatgagcgggaggtctccgtgcccgcagagatactgcggaagtctcggaaattcaccccagccctacccatttgggcgcggccggactataaccccccgctggtggagccgtggaaaaagcctgactacgaaccacctgtggtccatggctgcccgcttccacctccacagtcccctcctgtgcctccacctcggaagaagcggacggtgatcctcaccgaatcaaccctacctactgccttggccgagcttgccaccaaaagttttggcagctcctcaacttccggcattacgggcgacgacacgacaacatcccctgagcccgcctcctctagctgccctcccgactccgacgctgagtcctattcttccatgccccctctggagggggagcctggggatccggatctcagcgacgggtcatggtcgacggtcagtagtgaggccgacaaggaggatgtcgtgtgctgctcaatgtcttatacctggacaggcgcactcgtcaccccgtgcgccgcggaagaacaaaaactgcccatcaacgcactaagcaactcgttgctgcgtcatcacaatctggtgtattccaccacctcacgcagtgcttgccaaaggcagaagaaagtcacatttgacagactgcaagtcctggacagccattaccaggacgtgctcaaggaggttaaggcagcggcgtcaaaagtgaaggctaacttgctatccgtagaggaagcttgcagcctgacgcccccacactcagccaaatccaagtttggctatggggcaaaagacgtccgttgccatgccagaaaggccgtaaaccacatcaactccgtgtggaaagaccttctggaagacagtgtaacaccaatagacactaccatcatggctaagaacgaggttttctgcgttcagcctgagaaggggggtcgtaagccagctcgtctcatcgtgttccccgacctgggtgtacgcgtgtgcgagaagatggccttgtacgacgtagtcagcaagctccccctagccgtgatgggaagctcctacggattccaatactcaccaggacagcgggttgaattcctcgtgcaagcgtggaagtccaagaagaccccaatggggttttcgtatgatacccgctgttttgactccacagtcactgagaatgatatccgtacggaggaggcaatctaccaatgttgtgacctggacccccaagcccgcgtggccatcaagtccctcactgagaggctttatgtcgggggccctcttaccaattcaaggggggagaactgcggctatcgcaggtgccgcgcgagcggcgtactgacgaccagctgtggtaacaccctcacctgctacatcaaggcccgagcagcctgtcgagccgcagggctccaggactgcaccatgctcgtgtgtggcgacgacttagtcgttatctgtgagagtgcgggggtccaggaggacgcggcgagcctgagagccttcacggaggctatgaccaggtactccgccccccccggggaccccccacaaccagaatacgacttggagctcataacatcatgctcctccaacgtgtcagtcgcccacgacggcgctggaaaaagggtctactacctcacccgtgaccctacaacccccctcgcgcgggccgcgtgggagacagcaagacacactccagtcaattcctggctaggcaacataattatgtttgcccccacactgtgggcgaggatgatactgatgacccatttctttagcgtcctcatagccagggatcagcttgaacaggccctcgattgcgagatctacggggcctgctactccatagaaccactggatctacctccaatcattcaaagactccatggcctcagcgcattttcactccacagttactctccaggtgaaatcaatagggtggccgcatgcctcagaaaacttggggtcccgcccttgcgagcttggagacaccgggcccggaatgtccgcgctaggcttctgtccagaggaggcagggctgccatttgtggcaagtacctcttcaactgggcagtaaggacaaagctcaaactcactccaatagcggccgctggccggctagacttatctggctggttcacggctggctacagcgggggaggcatttttcacagcgtgtctcatgcccggccccgctggttctggttttgcctactcctgctcgctgcaggggtaggcatctacctcctccccaaccgatgaaggttggggtaaacactccggcctcttaggccatttcctgttttttttttttttttttttttttttttttttttttttttttttttctttttccctctttttcttctctttttccttctttaatggtggctccatcttagccctagtcacggctagctgtgaaaggtccgtgagccgcatgactgcagagagtgctgatactggcctctctgcagatcatgt

SEQ ID NO: 139 - DNA, 9599 bp, Artificial Sequence
  plasmid
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggcgcccatcacggcgtacgcccagcaaacgaggggcctcctagggtgtataatcaccagtctgaccggccgggacaaaaaccaagtggagggtgagatccagattgtgtcaactgctgcccaaaccttcctggcaacgtgcatcaacggggtttgctggaccgtctaccacggggccggaacgaggaccatcgcatcacccaagggtccggttatccaaatgtataccaatgtggacaaagaccttgtgggctggcccgctcctcaaggtgcccgctcactgacaccctgtacctgcggctcctcggacctttacctggtcacgaggcacgccgatgtcattcccgtgcgccggcggggtgatagcaggggcagcctgctttcgccccggcccatttcctacttgaaaggctcctcggggggtccgctgctgtgccccgcgggacacgccgtaggcttattcagggccgcggtgtgcacccgtggagtggctaaggcggtggacttcatccctgtggagaacctagagacaaccatgaggtccccggtgttcacggacaactcctctccaccagcagtgccccagagcttccaggtgggccacctgcatgctcccaccggcagcggcaaaagcaccaaggtcccggctgcatacgcagctcagggctataaggtgctagtgctcaacccctctgtcgctgcaacactgggctttggtgcttacatgtccaaggcccatggggtcgatcctaatatcaggaccggggtgagaacaattaccactggcagccccatcacgtactccacctacggcaagttccttgccgacggcgggtgttcagggggtgcttatgacataataatttgtgacgagtgccactccacggatgccacatccatcttgggcatcggcaccgttcttgaccaagcagagaccgcgggggcgagactggttgtgctcgccaccgctacccctccgggctccatcaccgtgccccatcctaacatcgaggaggttgctctgtccactaccggagagatccctttttacggcaaggctatccccctcgaggcgatcaagggggggagacatctcatcttctgtcactcaaagaagaagtgcgacgagctcgccgcaaagctggtcgcattgggcatcaatgccgtggcctactaccgcggtcttgacgtgtctgtcatcccaaccagcggcgatgttgtcgtcgtggcgaccgatgctcttatgactggctataccggcgactttgactcggtgatagactgcaacacgtgtgtcacccagacagtcgacctcagccttgaccctaccttcaccattgagacgaccacgctcccccaggacgctgtctcccgcacacaacgccggggcaggactggcagggggaagccaggcatctacagattcgtggcactgggggagcgcccctccggcatgttcgactcgtccgttctctgtgagtgctatgacgcgggctgtgcttggtatgagctcacgcccgccgagactacagttagactacgagcgtacatgaacaccccggggctccctgtgtgccaggaccatcttgaattttgggagggcgtctttacaggcctcacccatatagatgcccatttcctatctcagacaaagcagagcggggaaaactttccttacctggtagcataccaagcaaccgtgtgcgctagggctcaagcccctcccccatcgtgggaccagatgtggaagtgtttgactcgcctcaagcccaccctccatgggccaacacccttgctatacagactgggcgctgttcagaatgaagtcaccctgacgcacccaatcaccaaatacatcatgacatgcatgtcggccgacctggaggtcgtcacgagcacctgggtgctcgtcggcggcgtcctggccgctttggcctcgtattgcctgtcaacaggctgcgtggtcatagtgggcaggattgtcctgtctgggaagccggcaattatacctgacagggaagttctctaccgggagttcgatgagatggaagagtgctctcagcacttaccgtacatcgagcaagggatgatgctcgccgagcagttcaagcagaaggccctcggcctcctgcagaccgcgtcccgtcaggcagaggttgtcgcccctgctgtccagaccaactggcaaaaactcgaggccttctgggcgaagcatatgtggaacttcatcagtgggatacactacttggcgggcttgtcaacgttgcctggtaaccccgccattgcttcattgatggcttttacagctgctgtcaccagcccactaaccactagccaaaccctcctcttcaacatactgggggggtgggtggctgcccagcttgccgcccccggtgccgccaccgcctttgtgggcgctggcttagccggcgccgcaatcggcagtgttggactggggaaggtcctcgtggacattctagcagggtatggcgcgggcgtggcgggagctcttgtagcattcaagatcatgagcggtgaggtcccctccacggaggacctagtcaacctgctgcccgccatcctctcgcctggagcccttgtagtcggtgtggtctgcgcagcaatactgcgccggcacgtcggcccgggcgagggggcagtgcaatggatgaaccggctaatcgccttcgcctcccgggggaaccatgtttcccccacgcactatgtgccggagagcgatgcagctgcccgcgtcactaccatactcagcagcctcactgtaacccagctcctgaggcgactgcaccagtggataagctcggagtgtaccactccatgctccggttcctggctgagggacatctgggactggatatgcgaggtgctgagcgactttaagacctggctgaaagccaagctcatgccgcaactgcctgggattccctttgtgtcctgccagcgtgggtataagggggtctggcgaggggacggcatcatgcacactcgctgccactgtggagctgagataactggacatgtcaaaaacgggacgatgaggatcgttggtcctaagacttgcaggaacatgtggagtgggactttccccattaacgcctacaccacgggcccctgtactccccttcctgcgccgaactatacgttcgcgctgtggagggtgtctgcagaggaatacgtggagataaggcaggtgggggacttccactacgtgacgggtatgactactgacaaccttaaatgcccgtgccaggtcccatcgcccgaatttttcacagaattggacggggtgcgcctacataggtttgcgcccccttgcaagcccctgctgcgggaggaggtgtcattcagagtgggactccacgagtacccggtggggtcgcaattaccttgcgagcccgaaccggacgtggccgtgttgacgtccatgctcactgatccctcccatataacagcagaggcggccgggagaaggttggcgaggggatcacccccctctatggccagctcctcggctagccaactgtccgctccatctctcagggcaacttgcactaccaaccatgactcccctgatgctgagctcatagaggccaacctcctatggaggcaggagatgggcggcaacatcaccagggttgagtcagagaacaaagtggtgattctggactccttcgatccgcttgtggcagaggaggatgagcgggaggtctccgtgcccgcagagatactgcggaagtctcggaaattcaccccagccctacccatttgggcgcggccggactataaccccccgctggtggagccgtggaaaaagcctgactacgaaccacctgtggtccatggctgcccgcttccacctccacagtcccctcctgtgcctccacctcggaagaagcggacggtgatcctcaccgaatcaaccctacctactgccttggccgagcttgccaccaaaagttttggcagctcctcaacttccggcattacgggcgacgacacgacaacatcccctgagcccgcctcctctagctgccctcccgactccgacgctgagtcctattcttccatgccccctctggagggggagcctggggatccggatctcagcgacgggtcatggtcgacggtcagtagtgaggccgacaaggaggatgtcgtgtgctgctcaatgtcttatacctggacaggcgcactcgtcaccccgtgcgccgcggaagaacaaaaactgcccatcaacgcactaagcaactcgttgctgcgtcatcacaatctggtgtattccaccacctcacgcagtgcttgccaaaggcagaagaaagtcacatttgacagactgcaagtcctggacagccattaccaggacgtgctcaaggaggttaaggcagcggcgtcaaaagtgaaggctaacttgctatccgtagaggaagcttgcagcctgacgcccccacactcagccaaatccaagtttggctatggggcaaaagacgtccgttgccatgccagaaaggccgtaaaccacatcaactccgtgtggaaagaccttctggaagacagtgtaacaccaatagacactaccatcatggctaagaacgaggttttctgcgttcagcctgagaaggggggtcgtaagccagctcgtctcatcgtgttccccgacctgggtgtacgcgtgtgcgagaagatggccttgtacgacgtagtcagcaagctccccctagccgtgatgggaagctcctacggattccaatactcaccaggacagcgggttgaattcctcgtgcaagcgtggaagtccaagaagaccccaatggggttttcgtatgatacccgctgttttgactccacagtcactgagaatgatatccgtacggaggaggcaatctaccaatgttgtgacctggacccccaagcccgcgtggccatcaagtccctcactgagaggctttatgtcgggggccctcttaccaattcaaggggggagaactgcggctatcgcaggtgccgcgcgagcggcgtactgacgaccagctgtggtaacaccctcacctgctacatcaaggcccgagcagcctgtcgagccgcagggctccaggactgcaccatgctcgtgtgtggcgacgacttagtcgttatctgtgagagtgcgggggtccaggaggacgcggcgagcctgagagccttcacggaggctatgaccaggtactccgccccccccggggaccccccacaaccagaatacgacttggagctcataacatcatgctcctccaacgtgtcagtcgcccacgacggcgctggaaaaagggtctactacctcacccgtgaccctacaacccccctcgcgcgggccgcgtgggagacagcaagacacactccagtcaattcctggctaggcaacataattatgtttgcccccacactgtgggcgaggatgatactgatgacccatttctttagcgtcctcatagccagggatcagcttgaacaggccctcgattgcgagatctacggggcctgctactccatagaaccactggatctacctccaatcattcaaagactccatggcctcagcgcattttcactccacagttactctccaggtgaaatcaatagggtggccgcatgcctcagaaaacttggggtcccgcccttgcgagcttggagacaccgggcccggaatgtccgcgctaggcttctgtccagaggaggcagggctgccatttgtggcaagtacctcttcaactgggcagtaaggacaaagctcaaactcactccaatagcggccgctggccggctagacttatctggctggttcacggctggctacagcgggggaggcatttttcacagcgtgtctcatgcccggccccgctggttctggttttgcctactcctgctcgctgcaggggtaggcatctacctcctccccaaccgatgaaggttggggtaaacactccggcctcttaggccatttcctgttttttttttttttttttttttttttttttttttttttttttttttctttttccctctttttcttctctttttccttctttaatggtggctccatcttagccctagtcacggctagctgtgaaaggtccgtgagccgcatgactgcagagagtgctgatactggcctctctgcagatcatgt

SEQ ID NO: 140 - DNA, 9599 bp, Artificial Sequence
  plasmid
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggcgcccatcacggcgtacgcccagcaaacgaggggcctcctagggtgtataatcaccagtctgaccggccgggacaaaaaccaagtggagggtgagatccagattgtgtcaactgctgcccaaaccttcctggcaacgtgcatcaacggggtttgctggaccgtctaccacggggccggaacgaggaccatcgcatcacccaagggtccggttatccaaatgtataccaatgtggacaaagaccttgtgggctggcccgctcctcaaggtgcccgctcactgacaccctgtacctgcggctcctcggacctttacctggtcacgaggcacgccgatgtcattcccgtgcgccggcggggtgatagcaggggcagcctgctttcgccccggcccatttcctacttgaaaggctcctcggggggtccgctgctgtgccccgcgggacacgccgtaggcttattcagggccgcggtgtgcacccgtggagtggctaaggcggtggacttcatccctgtggagaacctagagacaaccatgaggtccccggtgttcacggacaactcctctccaccagcagtgccccagagcttccaggtgggccacctgcatgctcccaccggcagcggcaaaagcaccaaggtcccggctgcatacgcagctcagggctataaggtgctagtgctcaacccctctgtcgctgcaacactgggctttggtgcttacatgtccaaggcccatggggtcgatcctaatatcaggaccggggtgagaacaattaccactggcagccccatcacgtactccacctacggcaagttccttgccgacggcgggtgttcagggggtgcttatgacataataatttgtgacgagtgccactccacggatgccacatccatcttgggcatcggcaccgttcttgaccaagcagagaccgcgggggcgagactggttgtgctcgccaccgctacccctccgggctccatcaccgtgccccatcctaacatcgaggaggttgctctgtccactaccggagagatccctttttacggcaaggctatccccctcgaggcgatcaagggggggagacatctcatcttctgtcactcaaagaagaagtgcgacgagctcgccgcaaagctggtcgcattgggcatcaatgccgtggcctactaccgcggtcttgacgtgtctgtcatcccaaccagcggcgatgttgtcgtcgtggcgaccgatgctcttatgactggctataccggcgactttgactcggtgatagactgcaacacgtgtgtcacccagacagtcgacctcagccttgaccctaccttcaccattgagacgaccacgctcccccaggacgctgtctcccgcacacaacgccggggcaggactggcagggggaagccaggcatctacagattcgtggcactgggggagcgcccctccggcatgttcgactcgtccgttctctgtgagtgctatgacgcgggctgtgcttggtatgagctcacgcccgccgagactacagttagactacgagcgtacatgaacaccccggggctccctgtgtgccaggaccatcttgaattttgggagggcgtctttacaggcctcacccatatagatgcccatttcctatctcagacaaagcagagcggggaaaactttccttacctggtagcataccaagcaaccgtgtgcgctagggctcaagcccctcccccatcgtgggaccagatgtggaagtgtttgactcgcctcaagcccaccctccatgggccaacacccttgctatacagactgggcgctgttcagaatgaagtcaccctgacgcacccaatcaccaaatacatcatgacatgcatgtcggccgacctggaggtcgtcacgagcacctgggtgctcgtcggcggcgtcctggccgctttggcctcgtattgcctgtcaacaggctgcgtggtcatagtgggcaggattgtcctgtctgggaagccggcaattatacctgacagggaagttctctaccgggagttcgatgagatggaagagtgctctcagcacttaccgtacatcgagcaagggatgatgctcgccgagcagttcaagcagaaggccctcggcctcctgcagaccgcgtcccgtcaggcagaggttgtcgcccctgctgtccagaccaactggcaaaaactcgaggccttctgggcgaagcatatgtggaacttcatcagtgggatacaatacttggcgggcttgtcaacgttgcctggtaaccccgccattgcttcattgatggcttttacagctgctgtcaccagcccactaaccactagccaaaccctcctcttcaacatactgggggggtgggtggctgcccagcttgccgcccccggtgccgccaccgcctttgtgggcgctggcttagccggcgccgcaatcggcagtgttggactggggaaggtcctcgtggacattctagcagggtatggcgcgggcgtggcgggagctcttgtagcattcaagatcatgagcggtgaggtcccctccacggaggacctagtcaacctgctgcccgccatcctctcgcctggagcccttgtagtcggtgtggtctgcgcagcaatactgcgccggcacgtcggcccgggcgagggggcagtgcaatggatgaaccggctaatcgccttcgcctcccgggggaaccatgtttcccccacgcactatgtgccggagagcgatgcagctgcccgcgtcactaccatactcagcagcctcactgtaacccagctcctgaggcgactgcaccagtggataagctcggagtgtaccactccatgctccggttcctggctgagggacatctgggactggatatgcgaggtgctgagcgactttaagacctggctgaaagccaagctcatgccgcaactgcctgggattccctttgtgtcctgccagcgtgggtataagggggtctggcgaggggacggcatcatgcacactcgctgccactgtggagctgagataactggacatgtcaaaaacgggacgatgaggatcgttggtcctaagacttgcaggaacatgtggagtgggactttccccattaacgcctacaccacgggcccctgtactccccttcctgcgccgaactatacgttcgcgctgtggagggtgtctgcagaggaatacgtggagataaggcaggtgggggacttccactacgtgacgggtatgactactgacaaccttaaatgcccgtgccaggtcccatcgcccgaatttttcacagaattggacggggtgcgcctacataggtttgcgcccccttgcaagcccctgctgcgggaggaggtgtcattcagagtgggactccacgagtacccggtggggtcgcaattaccttgcgagcccgaaccggacgtggccgtgttgacgtccatgctcactgatccctcccatataacagcagaggcggccgggagaaggttggcgaggggatcacccccctctatggccagctcctcggctagccaactgtccgctccatctctcagggcaacttgcactaccaaccatgactcccctgatgctgagctcatagaggccaacctcctatggaggcaggagatgggcggcaacatcaccagggttgagtcagagaacaaagtggtgattctggactccttcgatccgcttgtggcagaggaggatgagcgggaggtctccgtgcccgcagagatactgcggaagtctcggaaattcaccccagccctacccatttgggcgcggccggactataaccccccgctggtggagccgtggaaaaagcctgactacgaaccacctgtggtccatggctgcccgcttccacctccacagtcccctcctgtgcctccacctcggaagaagcggacggtgatcctcaccgaatcaaccctacctactgccttggccgagcttgccaccaaaagttttggcagctcctcaacttccggcattacgggcgacgacacgacaacatcccctgagcccgcctcctctagctgccctcccgactccgacgctgagtcctattcttccatgccccctctggagggggagcctggggatccggatctcagcgacgggtcatggtcgacggtcagtagtgaggccgacaaggaggatgtcgtgtgctgctcaatgtcttatacctggacaggcgcactcgtcaccccgtgcgccgcggaagaacaaaaactgcccatcaacgcactaagcaactcgttgctgcgtcatcacaatctggtgtattccaccacctcacgcagtgcttgccaaaggcagaagaaagtcacatttgacagactgcaagtcctggacagccattaccaggacgtgctcaaggaggttaaggcagcggcgtcaaaagtgaaggctaacttgctatccgtagaggaagcttgcagcctgacgcccccacactcagccaaatccaagtttggctatggggcaaaagacgtccgttgccatgccagaaaggccgtaaaccacatcaactccgtgtggaaagaccttctggaagacagtgtaacaccaatagacactaccatcatggctaagaacgaggttttctgcgttcagcctgagaaggggggtcgtaagccagctcgtctcatcgtgttccccgacctgggtgtacgcgtgtgcgagaagatggccttgtacgacgtagtcagcaagctccccctagccgtgatgggaagctcctacggattccaatactcaccaggacagcgggttgaattcctcgtgcaagcgtggaagtccaagaagaccccaatggggttttcgtatgatacccgctgttttgactccacagtcactgagaatgatatccgtacggaggaggcaatctaccaatgttgtgacctggacccccaagcccgcgtggccatcaagtccctcactgagaggctttatgtcgggggccctcttaccaattcaaggggggagaactgcggctatcgcaggtgccgcgcgagcggcgtactgacgaccagctgtggtaacaccctcacctgctacatcaaggcccgagcagcctgtcgagccgcagggctccaggactgcaccatgctcgtgtgtggcgacgacttagtcgttatctgtgagagtgcgggggtccaggaggacgcggcgagcctgagagccttcacggaggctatgaccaggtactccgccccccccggggaccccccacaaccagaatacgacttggagctcataacatcatgctcctccaacgtgtcagtcgcccacgacggcgctggaaaaagggtctactacctcacccgtgaccctacaacccccctcgcgcgggccgcgtgggagacagcaagacacactccagtcaattcctggctaggcaacataattatgtttgcccccacactgtgggcgaggatgatactgatgacccatttctttagcgtcctcatagccagggatcagcttgaacaggccctcgattgcgagatctacggggcctgctactccatagaaccactggatctacctccaatcattcaaagactccatggcctcagcgcattttcactccacagttactctccaggtgaaatcaatagggtggccgcatgcctcagaaaacttggggtcccgcccttgcgagcttggagacaccgggcccggaatgtccgcgctaggcttctgtccagaggaggcagggctgccatttgtggcaagtacctcttcaactgggcagtaaggacaaagctcaaactcactccaatagcggccgctggccggctagacttatctggctggttcacggctggctacagcgggggaggcatttttcacagcgtgtctcatgcccggccccgctggttctggttttgcctactcctgctcgctgcaggggtaggcatctacctcctccccaaccgatgaaggttggggtaaacactccggcctcttaggccatttcctgttttttttttttttttttttttttttttttttttttttttttttttctttttccctctttttcttctctttttccttctttaatggtggctccatcttagccctagtcacggctagctgtgaaaggtccgtgagccgcatgactgcagagagtgctgatactggcctctctgcagatcatgt

SEQ ID NO: 141 - DNA, 9599 bp, Artificial Sequence
  plasmid
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggcgcccatcacggcgtacgcccagcaaacgaggggcctcctagggtgtataatcaccagtctgaccggccgggacaaaaaccaagtggagggtgagatccagattgtgtcaactgctgcccaaaccttcctggcaacgtgcatcaacggggtttgctggaccgtctaccacggggccggaacgaggaccatcgcatcacccaagggtccggttatccaaatgtataccaatgtggacaaagaccttgtgggctggcccgctcctcaaggtgcccgctcactgacaccctgtacctgcggctcctcggacctttacctggtcacgaggcacgccgatgtcattcccgtgcgccggcggggtgatagcaggggcagcctgctttcgccccggcccatttcctacttgaaaggctcctcggggggtccgctgctgtgccccgcgggacacgccgtaggcttattcagggccgcggtgtgcacccgtggagtggctaaggcggtggacttcatccctgtggagaacctagagacaaccatgaggtccccggtgttcacggacaactcctctccaccagcagtgccccagagcttccaggtgggccacctgcatgctcccaccggcagcggcaaaagcaccaaggtcccggctgcatacgcagctcagggctataaggtgctagtgctcaacccctctgtcgctgcaacactgggctttggtgcttacatgtccaaggcccatggggtcgatcctaatatcaggaccggggtgagaacaattaccactggcagccccatcacgtactccacctacggcaagttccttgccgacggcgggtgttcagggggtgcttatgacataataatttgtgacgagtgccactccacggatgccacatccatcttgggcatcggcaccgttcttgaccaagcagagaccgcgggggcgagactggttgtgctcgccaccgctacccctccgggctccatcaccgtgccccatcctaacatcgaggaggttgctctgtccactaccggagagatccctttttacggcaaggctatccccctcgaggcgatcaagggggggagacatctcatcttctgtcactcaaagaagaagtgcgacgagctcgccgcaaagctggtcgcattgggcatcaatgccgtggcctactaccgcggtcttgacgtgtctgtcatcccaaccagcggcgatgttgtcgtcgtggcgaccgatgctcttatgactggctataccggcgactttgactcggtgatagactgcaacacgtgtgtcacccagacagtcgacctcagccttgaccctaccttcaccattgagacgaccacgctcccccaggacgctgtctcccgcacacaacgccggggcaggactggcagggggaagccaggcatctacagattcgtggcactgggggagcgcccctccggcatgttcgactcgtccgttctctgtgagtgctatgacgcgggctgtgcttggtatgagctcacgcccgccgagactacagttagactacgagcgtacatgaacaccccggggctccctgtgtgccaggaccatcttgaattttgggagggcgtctttacaggcctcacccatatagatgcccatttcctatctcagacaaagcagagcggggaaaactttccttacctggtagcataccaagcaaccgtgtgcgctagggctcaagcccctcccccatcgtgggaccagatgtggaagtgtttgactcgcctcaagcccaccctccatgggccaacacccttgctatacagactgggcgctgttcagaatgaagtcaccctgacgcacccaatcaccaaatacatcatgacatgcatgtcggccgacctggaggtcgtcacgagcacctgggtgctcgtcggcggcgtcctggccgctttggcctcgtattgcctgtcaacaggctgcgtggtcatagtgggcaggattgtcctgtctgggaagccggcaattatacctgacagggaagttctctaccgggagttcgatgagatggaagagtgctctcagcacttaccgtacatcgagcaagggatgatgctcgccgagcagttcaagcagaaggccctcggcctcctgcagaccgcgtcccgtcaggcagaggttgtcgcccctgctgtccagaccaactggcaaaaactcgaggccttctgggcgaagcatatgtggaacttcatcagtgggatacactacttggcgggcttgtcaacgttgcctggtaaccccgccattgcttcattgatggcttttacagctgctgtcaccagcccactaaccactagccaaaccctcctcttcaacatactgggggggtgggtggctgcccagcttgccgcccccggtgccgccaccgcctttgtgggcgctggcttagccggcgccgcaatcggcagtgttggactggggaaggtcctcgtggacattctagcagggtatggcgcgggcgtggcgggagctcttgtagcattcaagatcatgagcggtgaggtcccctccacggaggacctagtcaacctgctgcccgccatcctctcgcctggagcccttgtagtcggtgtggtctgcgcagcaatactgcgccggcacgtcggcccgggcgagggggcagtgcaatggatgaaccggctaatcgccttcgcctcccgggggaaccatgtttcccccacgcactatgtgccggagagcgatgcagctgcccgcgtcactaccatactcagcagcctcactgtaacccagctcctgaggcgactgcaccagtggataagctcggagtgtaccactccatgctccggttcctggctgagggacatctgggactggatatgcgaggtgctgagcgactttaagacctggctgaaagccaagctcatgccgcaactgcctgggattccctttgtgtcctgccagcgtgggtataagggggtctggcgaggggacggcatcatgcacactcgctgccactgtggagctgagataactggacatgtcaaaaacgggacgatgaggatcgttggtcctaagacttgcaggaacatgtggagtgggactttccccattaacgcctacaccacgggcccctgtactccccttcctgcgccgaactatacgttcgcgctgtggagggtgtctgcagaggaatacgtggagataaggcaggtgggggacttccactacgtgacgggtatgactactgacaaccttaaatgcccgtgccaggtcccatcgcccgaatttttcacagaattggacggggtgcgcctacataggtttgcgcccccttgcaagcccctgctgcgggaggaggtgtcattcagagtgggactccacgagtacccggtggggtcgcaattaccttgcgagcccgaaccggacgtggccgtgttgacgtccatgctcactgatccctcccatataacagcagaggcggccgggagaaggttggcgaggggatcacccccctctatggccagctcctcggctagccaactgtccgctccatctctcagggcaacttgcactaccaaccatgactcccctgatgctgagctcatagaggccaacctcctatggaggcaggagatgggcggcaacatcaccagggttgagtcagagaacaaagtggtgattctggactccttcgatccgcttgtggcagaggaggatgagcgggaggtctccgtgcccgcagagatactgcggaagtctcggaaattcaccccagccctacccatttgggcgcggccggactataaccccccgctggtggagccgtggaaaaagcctgactacgaaccacctgtggtccatggctgcccgcttccacctccacagtcccctcctgtgcctccacctcggaagaagcggacggtgatcctcaccgaatcaaccctacctactgccttggccgagcttgccaccaaaagttttggcagctcctcaacttccggcattacgggcgacgacacgacaacatcccctgagcccgcctcctctagctgccctcccgactccgacgctgagtcctattcttccatgccccctctggagggggagcctggggatccggatctcagcgacgggtcatggtcgacggtcagtagtgaggccgacaaggaggatgtcgtgtgctgctcaatgtcttatacctggacaggcgcactcgtcaccccgtgcgccgcggaagaacaaaaactgcccatcaacgcactaagcaactcgttgctgcgtcatcacaatctggtgtattccaccacctcacgcagtgcttgccaaaggcagaagaaagtcacatttgacagactgcaagtcctggacagccattaccaggacgtgctcaaggaggttaaggcagcggcgtcaaaagtgaaggctaacttgctatccgtagaggaagcttgcagcctgacgcccccacactcagccaaatccaagtttggctatggggcaaaagacgtccgttgccatgccagaaaggccgtaaaccacatcaactccgtgtggaaagaccttctggaagacagtgtaacaccaatagacactaccatcatggctaagaacgaggttttctgcgttcagcctgagaaggggggtcgtaagccagctcgtctcatcgtgttccccgacctgggtgtacgcgtgtgcgagaagatggccttgtacgacgtagtcagcaagctccccctagccgtgatgggaagctcctacggattccaatactcaccaggacagcgggttgaattcctcgtgcaagcgtggaagtccaagaagaccccaatggggttttcgtatgatacccgctgttttgactccacagtcactgagaatgatatccgtacggaggaggcaatctaccaatgttgtgacctggacccccaagcccgcgtggccatcaagtccctcactgagaggctttatgtcgggggccctcttaccaattcaaggggggagaactgcggctatcgcaggtgccgcgcgagcggcgtactgacgaccagctgtggtaacaccctcacctgctacatcaaggcccgagcagcctgtcgagccgcagggctccaggactgcaccatgctcgtgtgtggcgacgacttagtcgttatctgtgagagtgcgggggtccaggaggacgcggcgagcctgagagccttcacggaggctatgaccaggtactccgccccccccggggaccccccacaaccagaatacgacttggagctcataacatcatgctcctccaacgtgtcagtcgcccacgacggcgctggaaaaagggtctactacctcacccgtgaccctacaacccccctcgcgcgggccgcgtgggagacagcaagacacactccagtcaattcctggctaggcaacataattatgtttgcccccacactgtgggcgaggatgatactgatgacccatttctttagcgtcctcatagccagggatcagcttgaacaggccctcgattgcgagatctacggggcctgctactccatagaaccactggatctacctccaatcattcaaagactccatggcctcagcgcattttcactccacagttactctccaggtgaaatcaatagggtggccgcatgcctcagaaaacttggggtcccgcccttgcgagcttggagacaccgggcccggaatgtccgcgctaggcttctgtccagaggaggcagggctgccatttgtggcaagtacctcttcaactgggcagtaaggacaaagctcaaactcactccaatagcggccgctggccggctagacttatctggctggttcacggctggctacagcgggggaggcatttttcacagcgtgtctcatgcccggccccgctggttctggtcttgcctactcctgctcgctgcaggggtaggcatctacctcctccccaaccgatgaaggttggggtaaacactccggcctcttaggccatttcctgttttttttttttttttttttttttttttttttttttttttttttttctttttccctctttttcttctctttttccttctttaatggtggctccatcttagccctagtcacggctagctgtgaaaggtccgtgagccgcatgactgcagagagtgctgatactggcctctctgcagatcatgt

SEQ ID NO: 142 - DNA, 9599 bp, Artificial Sequence
  plasmid
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggcgcccatcacggcgtacgcccagcaaacgaggggcctcctagggtgtataatcaccagtctgaccggccgggacaaaaaccaagtggagggtgagatccagattgtgtcaactgctgcccaaaccttcctggcaacgtgcatcaacggggtttgctggaccgtctaccacggggccggaacgaggaccatcgcatcacccaagggtccggttatccaaatgtataccaatgtggacaaagaccttgtgggctggcccgctcctcaaggtgcccgctcactgacaccctgtacctgcggctcctcggacctttacctggtcacgaggcacgccgatgtcattcccgtgcgccggcggggtgatagcaggggcagcctgctttcgccccggcccatttcctacttgaaaggctcctcggggggtccgctgctgtgccccgcgggacacgccgtaggcttattcagggccgcggtgtgcacccgtggagtggctaaggcggtggacttcatccctgtggagaacctagagacaaccatgaggtccccggtgttcacggacaactcctctccaccagcagtgccccagagcttccaggtgggccacctgcatgctcccaccggcagcggcaaaagcaccaaggtcccggctgcatacgcagctcagggctataaggtgctagtgctcaacccctctgtcgctgcaacactgggctttggtgcttacatgtccaaggcccatggggtcgatcctaatatcaggaccggggtgagaacaattaccactggcagccccatcacgtactccacctacggcaagttccttgccgacggcgggtgttcagggggtgcttatgacataataatttgtgacgagtgccactccacggatgccacatccatcttgggcatcggcaccgttcttgaccaagcagagaccgcgggggcgagactggttgtgctcgccaccgctacccctccgggctccatcaccgtgccccatcctaacatcgaggaggttgctctgtccactaccggagagatccctttttacggcaaggctatccccctcgaggcgatcaagggggggagacatctcatcttctgtcactcaaagaagaagtgcgacgagctcgccgcaaagctggtcgcattgggcatcaatgccgtggcctactaccgcggtcttgacgtgtctgtcatcccaaccagcggcgatgttgtcgtcgtggcgaccgatgctcttatgactggctataccggcgactttgactcggtgatagactgcaacacgtgtgtcacccagacagtcgacctcagccttgaccctaccttcaccattgagacgaccacgctcccccaggacgctgtctcccgcacacaacgccggggcaggactggcagggggaagccaggcatctacagattcgtggcactgggggagcgcccctccggcatgttcgactcgtccgttctctgtgagtgctatgacgcgggctgtgcttggtatgagctcacgcccgccgagactacagttagactacgagcgtacatgaacaccccggggctccctgtgtgccaggaccatcttgaattttgggagggcgtctttacaggcctcacccatatagatgcccatttcctatctcagacaaagcagagcggggaaaactttccttacctggtagcataccaagcaaccgtgtgcgctagggctcaagcccctcccccatcgtgggaccagatgtggaagtgtttgactcgcctcaagcccaccctccatgggccaacacccttgctatacagactgggcgctgttcagaatgaagtcaccctgacgcacccaatcaccaaatacatcatgacatgcatgtcggccgacctggaggtcgtcacgagcacctgggtgctcgtcggcggcgtcctggccgctttggcctcgtattgcctgtcaacaggctgcgtggtcatagtgggcaggattgtcctgtctgggaagccggcaattatacctgacagggaagttctctaccgggagttcgatgagatggaagagtgctctcagcacttaccgtacatcgagcaagggatgatgctcgccgagcagttcaagcagaaggccctcggcctcctgcagaccgcgtcccgtcaggcagaggttgtcgcccctgctgtccagaccaactggcaaaaactcgaggccttctgggcgaagcatatgtggaacttcatcagtgggatacaatacttggcgggcttgtcaacgttgcctggtaaccccgccattgcttcattgatggcttttacagctgctgtcaccagcccactaaccactagccaaaccctcctcttcaacatactgggggggtgggtggctgcccagcttgccgcccccggtgccgccaccgcctttgtgggcgctggcttagccggcgccgcaatcggcagtgttggactggggaaggtcctcgtggacattctagcagggtatggcgcgggcgtggcgggagctcttgtagcattcaagatcatgagcggtgaggtcccctccacggaggacctagtcaacctgctgcccgccatcctctcgcctggagcccttgtagtcggtgtggtctgcgcagcaatactgcgccggcacgtcggcccgggcgagggggcagtgcaatggatgaaccggctaatcgccttcgcctcccgggggagccatgtttcccccacgcactatgtgccggagagcgatgcagctgcccgcgtcactaccatactcagcagcctcactgtaacccagctcctgaggcgactgcaccagtggataagctcggagtgtaccactccatgctccggttcctggctgagggacatctgggactggatatgcgaggtgctgagcgactttaagacctggctgaaagccaagctcatgccgcaactgcctgggattccctttgtgtcctgccagcgtgggtataagggggtctggcgaggggacggcatcatgcacactcgctgccactgtggagctgagataactggacatgtcaaaaacgggacgatgaggatcgttggtcctaagacttgcaggaacatgtggagtgggactttccccattaacgcctacaccacgggcccctgtactccccttcctgcgccgaactatacgttcgcgctgtggagggtgtctgcagaggaatacgtggagataaggcaggtgggggacttccactacgtgacgggtatgactactgacaaccttaaatgcccgtgccaggtcccatcgcccgaatttttcacagaattggacggggtgcgcctacataggtttgcgcccccttgcaagcccctgctgcgggaggaggtgtcattcagagtgggactccacgagtacccggtggggtcgcaattaccttgcgagcccgaaccggacgtggccgtgttgacgtccatgctcactgatccctcccatataacagcagaggcggccgggagaaggttggcgaggggatcacccccctctatggccagctcctcggctagccaactgtccgctccatctctcagggcaacttgcactaccaaccatgactcccctgatgctgagctcatagaggccaacctcctatggaggcaggagatgggcggcaacatcaccagggttgagtcagagaacaaagtggtgattctggactccttcgatccgcttgtggcagaggaggatgagcgggaggtctccgtgcccgcagagatactgcggaagtctcggaaattcaccccagccctacccatttgggcgcggccggactataaccccccgctggtggagccgtggaaaaagcctgactacgaaccacctgtggtccatggctgcccgcttccacctccacagtcccctcctgtgcctccacctcggaagaagcggacggtgatcctcaccgaatcaaccctacctactgccttggccgagcttgccaccaaaagttttggcagctcctcaacttccggcattacgggcgacgacacgacaacatcccctgagcccgcctcctctagctgccctcccgactccgacgctgagtcctattcttccatgccccctctggagggggagcctggggatccggatctcagcgacgggtcatggtcgacggtcagtagtgaggccgacaaggaggatgtcgtgtgctgctcaatgtcttatacctggacaggcgcactcgtcaccccgtgcgccgcggaagaacaaaaactgcccatcaacgcactaagcaactcgttgctgcgtcatcacaatctggtgtattccaccacctcacgcagtgcttgccaaaggcagaagaaagtcacatttgacagactgcaagtcctggacagccattaccaggacgtgctcaaggaggttaaggcagcggcgtcaaaagtgaaggctaacttgctatccgtagaggaagcttgcagcctgacgcccccacactcagccaaatccaagtttggctatggggcaaaagacgtccgttgccatgccagaaaggccgtaaaccacatcaactccgtgtggaaagaccttctggaagacagtgtaacaccaatagacactaccatcatggctaagaacgaggttttctgcgttcagcctgagaaggggggtcgtaagccagctcgtctcatcgtgttccccgacctgggtgtacgcgtgtgcgagaagatggccttgtacgacgtagtcagcaagctccccctagccgtgatgggaagctcctacggattccaatactcaccaggacagcgggttgaattcctcgtgcaagcgtggaagtccaagaagaccccaatggggttttcgtatgatacccgctgttttgactccacagtcactgagaatgatatccgtacggaggaggcaatctaccaatgttgtgacctggacccccaagcccgcgtggccatcaagtccctcactgagaggctttatgtcgggggccctcttaccaattcaaggggggagaactgcggctatcgcaggtgccgcgcgagcggcgtactgacgaccagctgtggtaacaccctcacctgctacatcaaggcccgagcagcctgtcgagccgcagggctccaggactgcaccatgctcgtgtgtggcgacgacttagtcgttatctgtgagagtgcgggggtccaggaggacgcggcgagcctgagagccttcacggaggctatgaccaggtactccgccccccccggggaccccccacaaccagaatacgacttggagctcataacatcatgctcctccaacgtgtcagtcgcccacgacggcgctggaaaaagggtctactacctcacccgtgaccctacaacccccctcgcgcgggccgcgtgggagacagcaagacacactccagtcaattcctggctaggcaacataattatgtttgcccccacactgtgggcgaggatgatactgatgacccatttctttagcgtcctcatagccagggatcagcttgaacaggccctcgattgcgagatctacggggcctgctactccatagaaccactggatctacctccaatcattcaaagactccatggcctcagcgcattttcactccacagttactctccaggtgaaatcaatagggtggccgcatgcctcagaaaacttggggtcccgcccttgcgagcttggagacaccgggcccggaatgtccgcgctaggcttctgtccagaggaggcagggctgccatttgtggcaagtacctcttcaactgggcagtaaggacaaagctcaaactcactccaatagcggccgctggccggctagacttatctggctggttcacggctggctacagcgggggaggcatttttcacagcgtgtctcatgcccggccccgctggttctggtcttgcctactcctgctcgctgcaggggtaggcatctacctcctccccaaccgatgaaggttggggtaaacactccggcctcttaggccatttcctgttttttttttttttttttttttttttttttttttttttttttttttctttttccctctttttcttctctttttccttctttaatggtggctccatcttagccctagtcacggctagctgtgaaaggtccgtgagccgcatgactgcagagagtgctgatactggcctctctgcagatcatgt

SEQ ID NO: 143 - DNA, 9599 bp, Artificial Sequence
  plasmid
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggcgcccatcacggcgtacgcccagcaaacgaggggcctcctagggtgtataatcaccagtctgaccggccgggacaaaaaccaagtggagggtgagatccagattgtgtcaactgctgcccaaaccttcctggcaacgtgcatcaacggggtttgctggaccgtctaccacggggccggaacgaggaccatcgcatcacccaagggtccggttatccaaatgtataccaatgtggacaaagaccttgtgggctggcccgctcctcaaggtgcccgctcactgacaccctgtacctgcggctcctcggacctttacctggtcacgaggcacgccgatgtcattcccgtgcgccggcggggtgatagcaggggcagcctgctttcgccccggcccatttcctacttgaaaggctcctcggggggtccgctgctgtgccccgcgggacacgccgtaggcttattcagggccgcggtgtgcacccgtggagtggctaaggcggtggacttcatccctgtggagaacctagagacaaccatgaggtccccggtgttcacggacaactcctctccaccagcagtgccccagagcttccaggtgggccacctgcatgctcccaccggcagcggcaaaagcaccaaggtcccggctgcatacgcagctcagggctataaggtgctagtgctcaacccctctgtcgctgcaacactgggctttggtgcttacatgtccaaggcccatggggtcgatcctaatatcaggaccggggtgagaacaattaccactggcagccccatcacgtactccacctacggcaagttccttgccgacggcgggtgttcagggggtgcttatgacataataatttgtgacgagtgccactccacggatgccacatccatcttgggcatcggcaccgttcttgaccaagcagagaccgcgggggcgagactggttgtgctcgccaccgctacccctccgggctccatcaccgtgccccatcctaacatcgaggaggttgctctgtccactaccggagagatccctttttacggcaaggctatccccctcgaggcgatcaagggggggagacatctcatcttctgtcactcaaagaagaagtgcgacgagctcgccgcaaagctggtcgcattgggcatcaatgccgtggcctactaccgcggtcttgacgtgtctgtcatcccaaccagcggcgatgttgtcgtcgtggcgaccgatgctcttatgactggctataccggcgactttgactcggtgatagactgcaacacgtgtgtcacccagacagtcgacctcagccttgaccctaccttcaccattgagacgaccacgctcccccaggacgctgtctcccgcacacaacgccggggcaggactggcagggggaagccaggcatctacagattcgtggcactgggggagcgcccctccggcatgttcgactcgtccgttctctgtgagtgctatgacgcgggctgtgcttggtatgagctcacgcccgccgagactacagttagactacgagcgtacatgaacaccccggggctccctgtgtgccaggaccatcttgaattttgggagggcgtctttacaggcctcacccatatagatgcccatttcctatctcagacaaagcagagcggggaaaactttccttacctggtagcataccaagcaaccgtgtgcgctagggctcaagcccctcccccatcgtgggaccagatgtggaagtgtttgactcgcctcaagcccaccctccatgggccaacacccttgctatacagactgggcgctgttcagaatgaagtcaccctgacgcacccaatcaccaaatacatcatgacatgcatgtcggccgacctggaggtcgtcacgagcacctgggtgctcgtcggcggcgtcctggccgctttggcctcgtattgcctgtcaacaggctgcgtggtcatagtgggcaggattgtcctgtctgggaagccggcaattatacctgacagggaagttctctaccgggagttcgatgagatggaagagtgctctcagcacttaccgtacatcgagcaagggatgatgctcgccgagcagttcaagcagaaggccctcggcctcctgcagaccgcgtcccgtcaggcagaggttgtcgcccctgctgtccagaccaactggcaaaaactcgaggccttctgggcgaagcatatgtggaacttcatcagtgggatacaatacttggcgggcttgtcaacgttgcctggtaaccccgccattgcttcattgatggcttttacagctgctgtcaccagcccactaaccactagccaaaccctcctcttcaacatactgggggggtgggtggctgcccagcttgccgcccccggtgccgccaccgcctttgtgggcgctggcttagccggcgccgcaatcggcagtgttggactggggaaggtcctcgtggacattctagcagggtatggcgcgggcgtggcgggagctcttgtagcattcaagatcatgagcggtgaggtcccctccacggaggacctagtcaacctgctgcccgccatcctctcgcctggagcccttgtagtcggtgtggtctgcgcagcaatactgcgccggcacgtcggcccgggcgagggggcagtgcaatggatgaaccggctaatcgccttcgcctcccgggggacccatgtttcccccacgcactatgtgccggagagcgatgcagctgcccgcgtcactaccatactcagcagcctcactgtaacccagctcctgaggcgactgcaccagtggataagctcggagtgtaccactccatgctccggttcctggctgagggacatctgggactggatatgcgaggtgctgagcgactttaagacctggctgaaagccaagctcatgccgcaactgcctgggattccctttgtgtcctgccagcgtgggtataagggggtctggcgaggggacggcatcatgcacactcgctgccactgtggagctgagataactggacatgtcaaaaacgggacgatgaggatcgttggtcctaagacttgcaggaacatgtggagtgggactttccccattaacgcctacaccacgggcccctgtactccccttcctgcgccgaactatacgttcgcgctgtggagggtgtctgcagaggaatacgtggagataaggcaggtgggggacttccactacgtgacgggtatgactactgacaaccttaaatgcccgtgccaggtcccatcgcccgaatttttcacagaattggacggggtgcgcctacataggtttgcgcccccttgcaagcccctgctgcgggaggaggtgtcattcagagtgggactccacgagtacccggtggggtcgcaattaccttgcgagcccgaaccggacgtggccgtgttgacgtccatgctcactgatccctcccatataacagcagaggcggccgggagaaggttggcgaggggatcacccccctctatggccagctcctcggctagccaactgtccgctccatctctcagggcaacttgcactaccaaccatgactcccctgatgctgagctcatagaggccaacctcctatggaggcaggagatgggcggcaacatcaccagggttgagtcagagaacaaagtggtgattctggactccttcgatccgcttgtggcagaggaggatgagcgggaggtctccgtgcccgcagagatactgcggaagtctcggaaattcaccccagccctacccatttgggcgcggccggactataaccccccgctggtggagccgtggaaaaagcctgactacgaaccacctgtggtccatggctgcccgcttccacctccacagtcccctcctgtgcctccacctcggaagaagcggacggtgatcctcaccgaatcaaccctacctactgccttggccgagcttgccaccaaaagttttggcagctcctcaacttccggcattacgggcgacgacacgacaacatcccctgagcccgcctcctctagctgccctcccgactccgacgctgagtcctattcttccatgccccctctggagggggagcctggggatccggatctcagcgacgggtcatggtcgacggtcagtagtgaggccgacaaggaggatgtcgtgtgctgctcaatgtcttatacctggacaggcgcactcgtcaccccgtgcgccgcggaagaacaaaaactgcccatcaacgcactaagcaactcgttgctgcgtcatcacaatctggtgtattccaccacctcacgcagtgcttgccaaaggcagaagaaagtcacatttgacagactgcaagtcctggacagccattaccaggacgtgctcaaggaggttaaggcagcggcgtcaaaagtgaaggctaacttgctatccgtagaggaagcttgcagcctgacgcccccacactcagccaaatccaagtttggctatggggcaaaagacgtccgttgccatgccagaaaggccgtaaaccacatcaactccgtgtggaaagaccttctggaagacagtgtaacaccaatagacactaccatcatggctaagaacgaggttttctgcgttcagcctgagaaggggggtcgtaagccagctcgtctcatcgtgttccccgacctgggtgtacgcgtgtgcgagaagatggccttgtacgacgtagtcagcaagctccccctagccgtgatgggaagctcctacggattccaatactcaccaggacagcgggttgaattcctcgtgcaagcgtggaagtccaagaagaccccaatggggttttcgtatgatacccgctgttttgactccacagtcactgagaatgatatccgtacggaggaggcaatctaccaatgttgtgacctggacccccaagcccgcgtggccatcaagtccctcactgagaggctttatgtcgggggccctcttaccaattcaaggggggagaactgcggctatcgcaggtgccgcgcgagcggcgtactgacgaccagctgtggtaacaccctcacctgctacatcaaggcccgagcagcctgtcgagccgcagggctccaggactgcaccatgctcgtgtgtggcgacgacttagtcgttatctgtgagagtgcgggggtccaggaggacgcggcgagcctgagagccttcacggaggctatgaccaggtactccgccccccccggggaccccccacaaccagaatacgacttggagctcataacatcatgctcctccaacgtgtcagtcgcccacgacggcgctggaaaaagggtctactacctcacccgtgaccctacaacccccctcgcgcgggccgcgtgggagacagcaagacacactccagtcaattcctggctaggcaacataattatgtttgcccccacactgtgggcgaggatgatactgatgacccatttctttagcgtcctcatagccagggatcagcttgaacaggccctcgattgcgagatctacggggcctgctactccatagaaccactggatctacctccaatcattcaaagactccatggcctcagcgcattttcactccacagttactctccaggtgaaatcaatagggtggccgcatgcctcagaaaacttggggtcccgcccttgcgagcttggagacaccgggcccggaatgtccgcgctaggcttctgtccagaggaggcagggctgccatttgtggcaagtacctcttcaactgggcagtaaggacaaagctcaaactcactccaatagcggccgctggccggctagacttatctggctggttcacggctggctacagcgggggaggcatttttcacagcgtgtctcatgcccggccccgctggttctggtcttgcctactcctgctcgctgcaggggtaggcatctacctcctccccaaccgatgaaggttggggtaaacactccggcctcttaggccatttcctgttttttttttttttttttttttttttttttttttttttttttttttctttttccctctttttcttctctttttccttctttaatggtggctccatcttagccctagtcacggctagctgtgaaaggtccgtgagccgcatgactgcagagagtgctgatactggcctctctgcagatcatgt

SEQ ID NO: 144 - DNA, 9599 bp, Artificial Sequence
  plasmid
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggcgcccatcacggcgtacgcccagcaaacgaggggcctcctagggtgtataatcaccagtctgaccggccgggacaaaaaccaagtggagggtgagatccagattgtgtcaactgctgcccaaaccttcctggcaacgtgcatcaacggggtttgctggaccgtctaccacggggccggaacgaggaccatcgcatcacccaagggtccggttatccaaatgtataccaatgtggacaaagaccttgtgggctggcccgctcctcaaggtgcccgctcactgacaccctgtacctgcggctcctcggacctttacctggtcacgaggcacgccgatgtcattcccgtgcgccggcggggtgatagcaggggcagcctgctttcgccccggcccatttcctacttgaaaggctcctcggggggtccgctgctgtgccccgcgggacacgccgtaggcttattcagggccgcggtgtgcacccgtggagtggctaaggcggtggacttcatccctgtggagaacctagagacaaccatgaggtccccggtgttcacggacaactcctctccaccagcagtgccccagagcttccaggtgggccacctgcatgctcccaccggcagcggcaaaagcaccaaggtcccggctgcatacgcagctcagggctataaggtgctagtgctcaacccctctgtcgctgcaacactgggctttggtgcttacatgtccaaggcccatggggtcgatcctaatatcaggaccggggtgagaacaattaccactggcagccccatcacgtactccacctacggcaagttccttgccgacggcgggtgttcagggggtgcttatgacataataatttgtgacgagtgccactccacggatgccacatccatcttgggcatcggcaccgttcttgaccaagcagagaccgcgggggcgagactggttgtgctcgccaccgctacccctccgggctccatcaccgtgccccatcctaacatcgaggaggttgctctgtccactaccggagagatccctttttacggcaaggctatccccctcgaggcgatcaagggggggagacatctcatcttctgtcactcaaagaagaagtgcgacgagctcgccgcaaagctggtcgcattgggcatcaatgccgtggcctactaccgcggtcttgacgtgtctgtcatcccaaccagcggcgatgttgtcgtcgtggcgaccgatgctcttatgactggctataccggcgactttgactcggtgatagactgcaacacgtgtgtcacccagacagtcgacctcagccttgaccctaccttcaccattgagacgaccacgctcccccaggacgctgtctcccgcacacaacgccggggcaggactggcagggggaagccaggcatctacagattcgtggcactgggggagcgcccctccggcatgttcgactcgtccgttctctgtgagtgctatgacgcgggctgtgcttggtatgagctcacgcccgccgagactacagttagactacgagcgtacatgaacaccccggggctccctgtgtgccaggaccatcttgaattttgggagggcgtctttacaggcctcacccatatagatgcccatttcctatctcagacaaagcagagcggggaaaactttccttacctggtagcataccaagcaaccgtgtgcgctagggctcaagcccctcccccatcgtgggaccagatgtggaagtgtttgactcgcctcaagcccaccctccatgggccaacacccttgctatacagactgggcgctgttcagaatgaagtcaccctgacgcacccaatcaccaaatacatcatgacatgcatgtcggccgacctggaggtcgtcacgagcacctgggtgctcgtcggcggcgtcctggccgctttggcctcgtattgcctgtcaacaggctgcgtggtcatagtgggcaggattgtcctgtctgggaagccggcaattatacctgacagggaagttctctaccgggagttcgatgagatggaagagtgctctcagcacttaccgtacatcgagcaagggatgatgctcgccgagcagttcaagcagaaggccctcggcctcctgcagaccgcgtcccgtcaggcagaggttgtcgcccctgctgtccagaccaactggcaaaaactcgaggccttctgggcgaagcatatgtggaacttcatcagtgggatacactacttggcgggcttgtcaacgttgcctggtaaccccgccattgcttcattgatggcttttacagctgctgtcaccagcccactaaccactagccaaaccctcctcttcaacatactgggggggtgggtggctgcccagcttgccgcccccggtgccgccaccgcctttgtgggcgctggcttagccggcgccgcaatcggcagtgttggactggggaaggtcctcgtggacattctagcagggtatggcgcgggcgtggcgggagctcttgtagcattcaagatcatgagcggtgaggtcccctccacggaggacctagtcaacctgctgcccgccatcctctcgcctggagcccttgtagtcggtgtggtctgcgcagcaatactgcgccggcacgtcggcccgggcgagggggcagtgcaatggatgaaccggctaatcgccttcgcctcccgggggagccatgtttcccccacgcactatgtgccggagagcgatgcagctgcccgcgtcactaccatactcagcagcctcactgtaacccagctcctgaggcgactgcaccagtggataagctcggagtgtaccactccatgctccggttcctggctgagggacatctgggactggatatgcgaggtgctgagcgactttaagacctggctgaaagccaagctcatgccgcaactgcctgggattccctttgtgtcctgccagcgtgggtataagggggtctggcgaggggacggcatcatgcacactcgctgccactgtggagctgagataactggacatgtcaaaaacgggacgatgaggatcgttggtcctaagacttgcaggaacatgtggagtgggactttccccattaacgcctacaccacgggcccctgtactccccttcctgcgccgaactatacgttcgcgctgtggagggtgtctgcagaggaatacgtggagataaggcaggtgggggacttccactacgtgacgggtatgactactgacaaccttaaatgcccgtgccaggtcccatcgcccgaatttttcacagaattggacggggtgcgcctacataggtttgcgcccccttgcaagcccctgctgcgggaggaggtgtcattcagagtgggactccacgagtacccggtggggtcgcaattaccttgcgagcccgaaccggacgtggccgtgttgacgtccatgctcactgatccctcccatataacagcagaggcggccgggagaaggttggcgaggggatcacccccctctatggccagctcctcggctagccaactgtccgctccatctctcagggcaacttgcactaccaaccatgactcccctgatgctgagctcatagaggccaacctcctatggaggcaggagatgggcggcaacatcaccagggttgagtcagagaacaaagtggtgattctggactccttcgatccgcttgtggcagaggaggatgagcgggaggtctccgtgcccgcagagatactgcggaagtctcggaaattcaccccagccctacccatttgggcgcggccggactataaccccccgctggtggagccgtggaaaaagcctgactacgaaccacctgtggtccatggctgcccgcttccacctccacagtcccctcctgtgcctccacctcggaagaagcggacggtgatcctcaccgaatcaaccctacctactgccttggccgagcttgccaccaaaagttttggcagctcctcaacttccggcattacgggcgacgacacgacaacatcccctgagcccgcctcctctagctgccctcccgactccgacgctgagtcctattcttccatgccccctctggagggggagcctggggatccggatctcagcgacgggtcatggtcgacggtcagtagtgaggccgacaaggaggatgtcgtgtgctgctcaatgtcttatacctggacaggcgcactcgtcaccccgtgcgccgcggaagaacaaaaactgcccatcaacgcactaagcaactcgttgctgcgtcatcacaatctggtgtattccaccacctcacgcagtgcttgccaaaggcagaagaaagtcacatttgacagactgcaagtcctggacagccattaccaggacgtgctcaaggaggttaaggcagcggcgtcaaaagtgaaggctaacttgctatccgtagaggaagcttgcagcctgacgcccccacactcagccaaatccaagtttggctatggggcaaaagacgtccgttgccatgccagaaaggccgtaaaccacatcaactccgtgtggaaagaccttctggaagacagtgtaacaccaatagacactaccatcatggctaagaacgaggttttctgcgttcagcctgagaaggggggtcgtaagccagctcgtctcatcgtgttccccgacctgggtgtacgcgtgtgcgagaagatggccttgtacgacgtagtcagcaagctccccctagccgtgatgggaagctcctacggattccaatactcaccaggacagcgggttgaattcctcgtgcaagcgtggaagtccaagaagaccccaatggggttttcgtatgatacccgctgttttgactccacagtcactgagaatgatatccgtacggaggaggcaatctaccaatgttgtgacctggacccccaagcccgcgtggccatcaagtccctcactgagaggctttatgtcgggggccctcttaccaattcaaggggggagaactgcggctatcgcaggtgccgcgcgagcggcgtactgacgaccagctgtggtaacaccctcacctgctacatcaaggcccgagcagcctgtcgagccgcagggctccaggactgcaccatgctcgtgtgtggcgacgacttagtcgttatctgtgagagtgcgggggtccaggaggacgcggcgagcctgagagccttcacggaggctatgaccaggtactccgccccccccggggaccccccacaaccagaatacgacttggagctcataacatcatgctcctccaacgtgtcagtcgcccacgacggcgctggaaaaagggtctactacctcacccgtgaccctacaacccccctcgcgcgggccgcgtgggagacagcaagacacactccagtcaattcctggctaggcaacataattatgtttgcccccacactgtgggcgaggatgatactgatgacccatttctttagcgtcctcatagccagggatcagcttgaacaggccctcgattgcgagatctacggggcctgctactccatagaaccactggatctacctccaatcattcaaagactccatggcctcagcgcattttcactccacagttactctccaggtgaaatcaatagggtggccgcatgcctcagaaaacttggggtcccgcccttgcgagcttggagacaccgggcccggaatgtccgcgctaggcttctgtccagaggaggcagggctgccatttgtggcaagtacctcttcaactgggcagtaaggacaaagctcaaactcactccaatagcggccgctggccggctagacttatctggctggttcacggctggctacagcgggggaggcatttttcacagcgtgtctcatgcccggccccgctggttctggtcttgcctactcctgctcgctgcaggggtaggcatctacctcctccccaaccgatgaaggttggggtaaacactccggcctcttaggccatttcctgttttttttttttttttttttttttttttttttttttttttttttttctttttccctctttttcttctctttttccttctttaatggtggctccatcttagccctagtcacggctagctgtgaaaggtccgtgagccgcatgactgcagagagtgctgatactggcctctctgcagatcatgt

SEQ ID NO: 145 - DNA, 9599 bp, Artificial Sequence
  plasmid
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggcgcccatcacggcgtacgcccagcaaacgaggggcctcctagggtgtataatcaccagtctgaccggccgggacaaaaaccaagtggagggtgagatccagattgtgtcaactgctgcccaaaccttcctggcaacgtgcatcaacggggtttgctggaccgtctaccacggggccggaacgaggaccatcgcatcacccaagggtccggttatccaaatgtataccaatgtggacaaagaccttgtgggctggcccgctcctcaaggtgcccgctcactgacaccctgtacctgcggctcctcggacctttacctggtcacgaggcacgccgatgtcattcccgtgcgccggcggggtgatagcaggggcagcctgctttcgccccggcccatttcctacttgaaaggctcctcggggggtccgctgctgtgccccgcgggacacgccgtaggcttattcagggccgcggtgtgcacccgtggagtggctaaggcggtggacttcatccctgtggagaacctagagacaaccatgaggtccccggtgttcacggacaactcctctccaccagcagtgccccagagcttccaggtgggccacctgcatgctcccaccggcagcggcaaaagcaccaaggtcccggctgcatacgcagctcagggctataaggtgctagtgctcaacccctctgtcgctgcaacactgggctttggtgcttacatgtccaaggcccatggggtcgatcctaatatcaggaccggggtgagaacaattaccactggcagccccatcacgtactccacctacggcaagttccttgccgacggcgggtgttcagggggtgcttatgacataataatttgtgacgagtgccactccacggatgccacatccatcttgggcatcggcaccgttcttgaccaagcagagaccgcgggggcgagactggttgtgctcgccaccgctacccctccgggctccatcaccgtgccccatcctaacatcgaggaggttgctctgtccactaccggagagatccctttttacggcaaggctatccccctcgaggcgatcaagggggggagacatctcatcttctgtcactcaaagaagaagtgcgacgagctcgccgcaaagctggtcgcattgggcatcaatgccgtggcctactaccgcggtcttgacgtgtctgtcatcccaaccagcggcgatgttgtcgtcgtggcgaccgatgctcttatgactggctataccggcgactttgactcggtgatagactgcaacacgtgtgtcacccagacagtcgacctcagccttgaccctaccttcaccattgagacgaccacgctcccccaggacgctgtctcccgcacacaacgccggggcaggactggcagggggaagccaggcatctacagattcgtggcactgggggagcgcccctccggcatgttcgactcgtccgttctctgtgagtgctatgacgcgggctgtgcttggtatgagctcacgcccgccgagactacagttagactacgagcgtacatgaacaccccggggctccctgtgtgccaggaccatcttgaattttgggagggcgtctttacaggcctcacccatatagatgcccatttcctatctcagacaaagcagagcggggaaaactttccttacctggtagcataccaagcaaccgtgtgcgctagggctcaagcccctcccccatcgtgggaccagatgtggaagtgtttgactcgcctcaagcccaccctccatgggccaacacccttgctatacagactgggcgctgttcagaatgaagtcaccctgacgcacccaatcaccaaatacatcatgacatgcatgtcggccgacctggaggtcgtcacgagcacctgggtgctcgtcggcggcgtcctggccgctttggcctcgtattgcctgtcaacaggctgcgtggtcatagtgggcaggattgtcctgtctgggaagccggcaattatacctgacagggaagttctctaccgggagttcgatgagatggaagagtgctctcagcacttaccgtacatcgagcaagggatgatgctcgccgagcagttcaagcagaaggccctcggcctcctgcagaccgcgtcccgtcaggcagaggttgtcgcccctgctgtccagaccaactggcaaaaactcgaggccttctgggcgaagcatatgtggaacttcatcagtgggatacactacttggcgggcttgtcaacgttgcctggtaaccccgccattgcttcattgatggcttttacagctgctgtcaccagcccactaaccactagccaaaccctcctcttcaacatactgggggggtgggtggctgcccagcttgccgcccccggtgccgccaccgcctttgtgggcgctggcttagccggcgccgcaatcggcagtgttggactggggaaggtcctcgtggacattctagcagggtatggcgcgggcgtggcgggagctcttgtagcattcaagatcatgagcggtgaggtcccctccacggaggacctagtcaacctgctgcccgccatcctctcgcctggagcccttgtagtcggtgtggtctgcgcagcaatactgcgccggcacgtcggcccgggcgagggggcagtgcaatggatgaaccggctaatcgccttcgcctcccgggggacccatgtttcccccacgcactatgtgccggagagcgatgcagctgcccgcgtcactaccatactcagcagcctcactgtaacccagctcctgaggcgactgcaccagtggataagctcggagtgtaccactccatgctccggttcctggctgagggacatctgggactggatatgcgaggtgctgagcgactttaagacctggctgaaagccaagctcatgccgcaactgcctgggattccctttgtgtcctgccagcgtgggtataagggggtctggcgaggggacggcatcatgcacactcgctgccactgtggagctgagataactggacatgtcaaaaacgggacgatgaggatcgttggtcctaagacttgcaggaacatgtggagtgggactttccccattaacgcctacaccacgggcccctgtactccccttcctgcgccgaactatacgttcgcgctgtggagggtgtctgcagaggaatacgtggagataaggcaggtgggggacttccactacgtgacgggtatgactactgacaaccttaaatgcccgtgccaggtcccatcgcccgaatttttcacagaattggacggggtgcgcctacataggtttgcgcccccttgcaagcccctgctgcgggaggaggtgtcattcagagtgggactccacgagtacccggtggggtcgcaattaccttgcgagcccgaaccggacgtggccgtgttgacgtccatgctcactgatccctcccatataacagcagaggcggccgggagaaggttggcgaggggatcacccccctctatggccagctcctcggctagccaactgtccgctccatctctcagggcaacttgcactaccaaccatgactcccctgatgctgagctcatagaggccaacctcctatggaggcaggagatgggcggcaacatcaccagggttgagtcagagaacaaagtggtgattctggactccttcgatccgcttgtggcagaggaggatgagcgggaggtctccgtgcccgcagagatactgcggaagtctcggaaattcaccccagccctacccatttgggcgcggccggactataaccccccgctggtggagccgtggaaaaagcctgactacgaaccacctgtggtccatggctgcccgcttccacctccacagtcccctcctgtgcctccacctcggaagaagcggacggtgatcctcaccgaatcaaccctacctactgccttggccgagcttgccaccaaaagttttggcagctcctcaacttccggcattacgggcgacgacacgacaacatcccctgagcccgcctcctctagctgccctcccgactccgacgctgagtcctattcttccatgccccctctggagggggagcctggggatccggatctcagcgacgggtcatggtcgacggtcagtagtgaggccgacaaggaggatgtcgtgtgctgctcaatgtcttatacctggacaggcgcactcgtcaccccgtgcgccgcggaagaacaaaaactgcccatcaacgcactaagcaactcgttgctgcgtcatcacaatctggtgtattccaccacctcacgcagtgcttgccaaaggcagaagaaagtcacatttgacagactgcaagtcctggacagccattaccaggacgtgctcaaggaggttaaggcagcggcgtcaaaagtgaaggctaacttgctatccgtagaggaagcttgcagcctgacgcccccacactcagccaaatccaagtttggctatggggcaaaagacgtccgttgccatgccagaaaggccgtaaaccacatcaactccgtgtggaaagaccttctggaagacagtgtaacaccaatagacactaccatcatggctaagaacgaggttttctgcgttcagcctgagaaggggggtcgtaagccagctcgtctcatcgtgttccccgacctgggtgtacgcgtgtgcgagaagatggccttgtacgacgtagtcagcaagctccccctagccgtgatgggaagctcctacggattccaatactcaccaggacagcgggttgaattcctcgtgcaagcgtggaagtccaagaagaccccaatggggttttcgtatgatacccgctgttttgactccacagtcactgagaatgatatccgtacggaggaggcaatctaccaatgttgtgacctggacccccaagcccgcgtggccatcaagtccctcactgagaggctttatgtcgggggccctcttaccaattcaaggggggagaactgcggctatcgcaggtgccgcgcgagcggcgtactgacgaccagctgtggtaacaccctcacctgctacatcaaggcccgagcagcctgtcgagccgcagggctccaggactgcaccatgctcgtgtgtggcgacgacttagtcgttatctgtgagagtgcgggggtccaggaggacgcggcgagcctgagagccttcacggaggctatgaccaggtactccgccccccccggggaccccccacaaccagaatacgacttggagctcataacatcatgctcctccaacgtgtcagtcgcccacgacggcgctggaaaaagggtctactacctcacccgtgaccctacaacccccctcgcgcgggccgcgtgggagacagcaagacacactccagtcaattcctggctaggcaacataattatgtttgcccccacactgtgggcgaggatgatactgatgacccatttctttagcgtcctcatagccagggatcagcttgaacaggccctcgattgcgagatctacggggcctgctactccatagaaccactggatctacctccaatcattcaaagactccatggcctcagcgcattttcactccacagttactctccaggtgaaatcaatagggtggccgcatgcctcagaaaacttggggtcccgcccttgcgagcttggagacaccgggcccggaatgtccgcgctaggcttctgtccagaggaggcagggctgccatttgtggcaagtacctcttcaactgggcagtaaggacaaagctcaaactcactccaatagcggccgctggccggctagacttatctggctggttcacggctggctacagcgggggaggcatttttcacagcgtgtctcatgcccggccccgctggttctggtcttgcctactcctgctcgctgcaggggtaggcatctacctcctccccaaccgatgaaggttggggtaaacactccggcctcttaggccatttcctgttttttttttttttttttttttttttttttttttttttttttttttctttttccctctttttcttctctttttccttctttaatggtggctccatcttagccctagtcacggctagctgtgaaaggtccgtgagccgcatgactgcagagagtgctgatactggcctctctgcagatcatgt

SEQ ID NO: 146 - protein, 3011 aa, Artificial Sequence
  plasmid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGCIITSLTGRDKNQVEGEIQIVSTAAQTFLATCINGVCWTVYHGAGTRTIASPKGPVIQMYTNVDKDLVGWPAPQGARSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVPQSFQVAHLHAPTGSGKSTKVPAAYAAQGYKVLVLNPSVAATLGFGAYMSKAHGVDPNIRTGVRTITTGSPITYSTYGKFLADGGCSGGAYDIIICDECHSTDATSILGIGTVLDQAETAGARLVVLATATPPGSITVPHPNIEEVALSTTGEIPFYGKAIPLEAIKGGRHLIFCHSKKKCDELAAKLVALGINAVAYYRGLDVSVIPTSGDVVVVATDALMTGYTGDFDSVIDCNTCVTQTVDFSLDPTFTIETTTLPQDAVSRTQRRGRTGRGKPGIYRFVALGERPSGMFDSSVLCECYDAGCAWYELTPAETTVRLRAYMNTPGLPVCQDHLEFWEGVFTGLTHIDAHFLSQTKQSGENFPYLVAYQATVCARAQAPPPSWDQMWKCLTRLKPTLHGPTPLLYRLGAVQNEVTLTHPITKYIMTCMSADLEVVTSTWVLVGGVLAALAAYCLSTGCVVIVGRIVLSGKPAIIPDREVLYREFDEMEECSQHLPYIEQGMMLAEQFKQKALGLLQTASRQAEVVAPAVQTNWQKLEAFWAKHMWNFISGIQYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTTILSSLTVTQLLRRLHQWISSECTTPCSGSWLRDIWDWICEVLSDFKTWLKAKLMPQLPGIPFVSCQRGYKGVWRGDGIMHTRCHCGAEITGHVKNGTMRIVGPKTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSMASSSASQLSAPSLRATCTTNHDSPDAELIEANLLWRQEMGGNITRVESENKVVILDSFDPLVAEEDEREVSVPAEILRKSRKFTPALPIWARPDYNPPLVEPWKKPDYEPPVVHGCPLPPPQSPPVPPPRKKRTVILTESTLPTALAELATKSFGSSSTSGITGDDTTTSPEPASSSCPPDSDAESYSSMPPLEGEPGDPDLSDGSWSTVSSEADKEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 147 - protein, 3011 aa, Artificial Sequence
  plasmid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGCIITSLTGRDKNQVEGEIQIVSTAAQTFLATCINGVCWTVYHGAGTRTIASPKGPVIQMYTNVDKDLVGWPAPQGARSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVPQSFQVAHLHAPTGSGKSTKVPAAYAAQGYKVLVLNPSVAATLGFGAYMSKAHGVDPNIRTGVRTITTGSPITYSTYGKFLADGGCSGGAYDIIICDECHSTDATSILGIGTVLDQAETAGARLVVLATATPPGSITVPHPNIEEVALSTTGEIPFYGKAIPLEAIKGGRHLIFCHSKKKCDELAAKLVALGINAVAYYRGLDVSVIPTSGDVVVVATDALMTGYTGDFDSVIDCNTCVTQTVDLSLDPTFTIETTTLPQDAVSRTQRRGRTGRGKPGIYRFVALGERPSGMFDSSVLCECYDAGCAWYELTPAETTVRLRAYMNTPGLPVCQDHLEFWEGVFTGLTHIDAHFLSQTKQSGENFPYLVAYQATVCARAQAPPPSWDQMWKCLTRLKPTLHGPTPLLYRLGAVQNEVTLTHPITKYIMTCMSADLEVVTSTWVLVGGVLAALASYCLSTGCVVIVGRIVLSGKPAIIPDREVLYREFDEMEECSQHLPYIEQGMMLAEQFKQKALGLLQTASRQAEVVAPAVQTNWQKLEAFWAKHMWNFISGIQYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTTILSSLTVTQLLRRLHQWISSECTTPCSGSWLRDIWDWICEVLSDFKTWLKAKLMPQLPGIPFVSCQRGYKGVWRGDGIMHTRCHCGAEITGHVKNGTMRIVGPKTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSMASSSASQLSAPSLRATCTTNHDSPDAELIEANLLWRQEMGGNITRVESENKVVILDSFDPLVAEEDEREVSVPAEILRKSRKFTPALPIWARPDYNPPLVEPWKKPDYEPPVVHGCPLPPPQSPPVPPPRKKRTVILTESTLPTALAELATKSFGSSSTSGITGDDTTTSPEPASSSCPPDSDAESYSSMPPLEGEPGDPDLSDGSWSTVSSEADKEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGGIFHSVSRARPRSLLFGLLLLFVGVGLFLLPAR

SEQ ID NO: 148 - protein, 3011 aa, Artificial Sequence
  plasmid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGCIITSLTGRDKNQVEGEIQIVSTAAQTFLATCINGVCWTVYHGAGTRTIASPKGPVIQMYTNVDKDLVGWPAPQGARSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVPQSFQVGHLHAPTGSGKSTKVPAAYAAQGYKVLVLNPSVAATLGFGAYMSKAHGVDPNIRTGVRTITTGSPITYSTYGKFLADGGCSGGAYDIIICDECHSTDATSILGIGTVLDQAETAGARLVVLATATPPGSITVPHPNIEEVALSTTGEIPFYGKAIPLEAIKGGRHLIFCHSKKKCDELAAKLVALGINAVAYYRGLDVSVIPTSGDVVVVATDALMTGYTGDFDSVIDCNTCVTQTVDLSLDPTFTIETTTLPQDAVSRTQRRGRTGRGKPGIYRFVALGERPSGMFDSSVLCECYDAGCAWYELTPAETTVRLRAYMNTPGLPVCQDHLEFWEGVFTGLTHIDAHFLSQTKQSGENFPYLVAYQATVCARAQAPPPSWDQMWKCLTRLKPTLHGPTPLLYRLGAVQNEVTLTHPITKYIMTCMSADLEVVTSTWVLVGGVLAALASYCLSTGCVVIVGRIVLSGKPAIIPDREVLYREFDEMEECSQHLPYIEQGMMLAEQFKQKALGLLQTASRQAEVVAPAVQTNWQKLEAFWAKHMWNFISGIHYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTTILSSLTVTQLLRRLHQWISSECTTPCSGSWLRDIWDWICEVLSDFKTWLKAKLMPQLPGIPFVSCQRGYKGVWRGDGIMHTRCHCGAEITGHVKNGTMRIVGPKTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSMASSSASQLSAPSLRATCTTNHDSPDAELIEANLLWRQEMGGNITRVESENKVVILDSFDPLVAEEDEREVSVPAEILRKSRKFTPALPIWARPDYNPPLVEPWKKPDYEPPVVHGCPLPPPQSPPVPPPRKKRTVILTESTLPTALAELATKSFGSSSTSGITGDDTTTSPEPASSSCPPDSDAESYSSMPPLEGEPGDPDLSDGSWSTVSSEADKEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGGIFHSVSRARPRSLLFGLLLLFVGVGLFLLPAR

SEQ ID NO: 149 - protein, 3011 aa, Artificial Sequence
  plasmid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGCIITSLTGRDKNQVEGEIQIVSTAAQTFLATCINGVCWTVYHGAGTRTIASPKGPVIQMYTNVDKDLVGWPAPQGARSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVPQSFQVGHLHAPTGSGKSTKVPAAYAAQGYKVLVLNPSVAATLGFGAYMSKAHGVDPNIRTGVRTITTGSPITYSTYGKFLADGGCSGGAYDIIICDECHSTDATSILGIGTVLDQAETAGARLVVLATATPPGSITVPHPNIEEVALSTTGEIPFYGKAIPLEAIKGGRHLIFCHSKKKCDELAAKLVALGINAVAYYRGLDVSVIPTSGDVVVVATDALMTGYTGDFDSVIDCNTCVTQTVDLSLDPTFTIETTTLPQDAVSRTQRRGRTGRGKPGIYRFVALGERPSGMFDSSVLCECYDAGCAWYELTPAETTVRLRAYMNTPGLPVCQDHLEFWEGVFTGLTHIDAHFLSQTKQSGENFPYLVAYQATVCARAQAPPPSWDQMWKCLTRLKPTLHGPTPLLYRLGAVQNEVTLTHPITKYIMTCMSADLEVVTSTWVLVGGVLAALASYCLSTGCVVIVGRIVLSGKPAIIPDREVLYREFDEMEECSQHLPYIEQGMMLAEQFKQKALGLLQTASRQAEVVAPAVQTNWQKLEAFWAKHMWNFISGIQYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTTILSSLTVTQLLRRLHQWISSECTTPCSGSWLRDIWDWICEVLSDFKTWLKAKLMPQLPGIPFVSCQRGYKGVWRGDGIMHTRCHCGAEITGHVKNGTMRIVGPKTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSMASSSASQLSAPSLRATCTTNHDSPDAELIEANLLWRQEMGGNITRVESENKVVILDSFDPLVAEEDEREVSVPAEILRKSRKFTPALPIWARPDYNPPLVEPWKKPDYEPPVVHGCPLPPPQSPPVPPPRKKRTVILTESTLPTALAELATKSFGSSSTSGITGDDTTTSPEPASSSCPPDSDAESYSSMPPLEGEPGDPDLSDGSWSTVSSEADKEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGGIFHSVSRARPRSLLFGLLLLFVGVGLFLLPAR

SEQ ID NO: 150 - protein, 3011 aa, Artificial Sequence
  plasmid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGCIITSLTGRDKNQVEGEIQIVSTAAQTFLATCINGVCWTVYHGAGTRTIASPKGPVIQMYTNVDKDLVGWPAPQGARSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVPQSFQVAHLHAPTGSGKSTKVPAAYAAQGYKVLVLNPSVAATLGFGAYMSKAHGVDPNIRTGVRTITTGSPITYSTYGKFLADGGCSGGAYDIIICDECHSTDATSILGIGTVLDQAETAGARLVVLATATPPGSITVPHPNIEEVALSTTGEIPFYGKAIPLEAIKGGRHLIFCHSKKKCDELAAKLVALGINAVAYYRGLDVSVIPTSGDVVVVATDALMTGYTGDFDSVIDCNTCVTQTVDLSLDPTFTIETTTLPQDAVSRTQRRGRTGRGKPGIYRFVALGERPSGMFDSSVLCECYDAGCAWYELTPAETTVRLRAYMNTPGLPVCQDHLEFWEGVFTGLTHIDAHFLSQTKQSGENFPYLVAYQATVCARAQAPPPSWDQMWKCLTRLKPTLHGPTPLLYRLGAVQNEVTLTHPITKYIMTCMSADLEVVTSTWVLVGGVLAALASYCLSTGCVVIVGRIVLSGKPAIIPDREVLYREFDEMEECSQHLPYIEQGMMLAEQFKQKALGLLQTASRQAEVVAPAVQTNWQKLEAFWAKHMWNFISGIHYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTTILSSLTVTQLLRRLHQWISSECTTPCSGSWLRDIWDWICEVLSDFKTWLKAKLMPQLPGIPFVSCQRGYKGVWRGDGIMHTRCHCGAEITGHVKNGTMRIVGPKTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSMASSSASQLSAPSLRATCTTNHDSPDAELIEANLLWRQEMGGNITRVESENKVVILDSFDPLVAEEDEREVSVPAEILRKSRKFTPALPIWARPDYNPPLVEPWKKPDYEPPVVHGCPLPPPQSPPVPPPRKKRTVILTESTLPTALAELATKSFGSSSTSGITGDDTTTSPEPASSSCPPDSDAESYSSMPPLEGEPGDPDLSDGSWSTVSSEADKEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGGIFHSVSRARPRSLLFGLLLLFVGVGLFLLPAR

SEQ ID NO: 151 - protein, 3011 aa, Artificial Sequence
  plasmid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGCIITSLTGRDKNQVEGEIQIVSTAAQTFLATCINGVCWTVYHGAGTRTIASPKGPVIQMYTNVDKDLVGWPAPQGARSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVPQSFQVAHLHAPTGSGKSTKVPAAYAAQGYKVLVLNPSVAATLGFGAYMSKAHGVDPNIRTGVRTITTGSPITYSTYGKFLADGGCSGGAYDIIICDECHSTDATSILGIGTVLDQAETAGARLVVLATATPPGSITVPHPNIEEVALSTTGEIPFYGKAIPLEAIKGGRHLIFCHSKKKCDELAAKLVALGINAVAYYRGLDVSVIPTSGDVVVVATDALMTGYTGDFDSVIDCNTCVTQTVDLSLDPTFTIETTTLPQDAVSRTQRRGRTGRGKPGIYRFVALGERPSGMFDSSVLCECYDAGCAWYELTPAETTVRLRAYMNTPGLPVCQDHLEFWEGVFTGLTHIDAHFLSQTKQSGENFPYLVAYQATVCARAQAPPPSWDQMWKCLTRLKPTLHGPTPLLYRLGAVQNEVTLTHPITKYIMTCMSADLEVVTSTWVLVGGVLAALASYCLSTGCVVIVGRIVLSGKPAIIPDREVLYREFDEMEECSQHLPYIEQGMMLAEQFKQKALGLLQTASRQAEVVAPAVQTNWQKLEAFWAKHMWNFISGIQYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTTILSSLTVTQLLRRLHQWISSECTTPCSGSWLRDIWDWICEVLSDFKTWLKAKLMPQLPGIPFVSCQRGYKGVWRGDGIMHTRCHCGAEITGHVKNGTMRIVGPKTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSMASSSASQLSAPSLRATCTTNHDSPDAELIEANLLWRQEMGGNITRVESENKVVILDSFDPLVAEEDEREVSVPAEILRKSRKFTPALPIWARPDYNPPLVEPWKKPDYEPPVVHGCPLPPPQSPPVPPPRKKRTVILTESTLPTALAELATKSFGSSSTSGITGDDTTTSPEPASSSCPPDSDAESYSSMPPLEGEPGDPDLSDGSWSTVSSEADKEDVVCCSMSYTWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVFPDLGVRVCEKMALYDVVSKLPLAVMGSSYGFQYSPGQRVEFLVQAWKSKKTPMGFSYDTRCFDSTVTENDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARNVRARLLSRGGRAAICGKYLFNWAVRTKLKLTPIAAAGRLDLSGWFTAGYSGGGIFHSVSHARPRWFWFCLLLLAAGVGIYLLPNR

SEQ ID NO: 152 - protein, 3011 aa, Artificial Sequence
  plasmid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGCIITSLTGRDKNQVEGEIQIVSTAAQTFLATCINGVCWTVYHGAGTRTIASPKGPVIQMYTNVDKDLVGWPAPQGARSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVPQSFQVGHLHAPTGSGKSTKVPAAYAAQGYKVLVLNPSVAATLGFGAYMSKAHGVDPNIRTGVRTITTGSPITYSTYGKFLADGGCSGGAYDIIICDECHSTDATSILGIGTVLDQAETAGARLVVLATATPPGSITVPHPNIEEVALSTTGEIPFYGKAIPLEAIKGGRHLIFCHSKKKCDELAAKLVALGINAVAYYRGLDVSVIPTSGDVVVVATDALMTGYTGDFDSVIDCNTCVTQTVDLSLDPTFTIETTTLPQDAVSRTQRRGRTGRGKPGIYRFVALGERPSGMFDSSVLCECYDAGCAWYELTPAETTVRLRAYMNTPGLPVCQDHLEFWEGVFTGLTHIDAHFLSQTKQSGENFPYLVAYQATVCARAQAPPPSWDQMWKCLTRLKPTLHGPTPLLYRLGAVQNEVTLTHPITKYIMTCMSADLEVVTSTWVLVGGVLAALASYCLSTGCVVIVGRIVLSGKPAIIPDREVLYREFDEMEECSQHLPYIEQGMMLAEQFKQKALGLLQTASRQAEVVAPAVQTNWQKLEAFWAKHMWNFISGIHYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTTILSSLTVTQLLRRLHQWISSECTTPCSGSWLRDIWDWICEVLSDFKTWLKAKLMPQLPGIPFVSCQRGYKGVWRGDGIMHTRCHCGAEITGHVKNGTMRIVGPKTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSMASSSASQLSAPSLRATCTTNHDSPDAELIEANLLWRQEMGGNITRVESENKVVILDSFDPLVAEEDEREVSVPAEILRKSRKFTPALPIWARPDYNPPLVEPWKKPDYEPPVVHGCPLPPPQSPPVPPPRKKRTVILTESTLPTALAELATKSFGSSSTSGITGDDTTTSPEPASSSCPPDSDAESYSSMPPLEGEPGDPDLSDGSWSTVSSEADKEDVVCCSMSYTWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVFPDLGVRVCEKMALYDVVSKLPLAVMGSSYGFQYSPGQRVEFLVQAWKSKKTPMGFSYDTRCFDSTVTENDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARNVRARLLSRGGRAAICGKYLFNWAVRTKLKLTPIAAAGRLDLSGWFTAGYSGGGIFHSVSHARPRWFWFCLLLLAAGVGIYLLPNR

SEQ ID NO: 153 - protein, 3011 aa, Artificial Sequence
  plasmid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGCIITSLTGRDKNQVEGEIQIVSTAAQTFLATCINGVCWTVYHGAGTRTIASPKGPVIQMYTNVDKDLVGWPAPQGARSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVPQSFQVGHLHAPTGSGKSTKVPAAYAAQGYKVLVLNPSVAATLGFGAYMSKAHGVDPNIRTGVRTITTGSPITYSTYGKFLADGGCSGGAYDIIICDECHSTDATSILGIGTVLDQAETAGARLVVLATATPPGSITVPHPNIEEVALSTTGEIPFYGKAIPLEAIKGGRHLIFCHSKKKCDELAAKLVALGINAVAYYRGLDVSVIPTSGDVVVVATDALMTGYTGDFDSVIDCNTCVTQTVDLSLDPTFTIETTTLPQDAVSRTQRRGRTGRGKPGIYRFVALGERPSGMFDSSVLCECYDAGCAWYELTPAETTVRLRAYMNTPGLPVCQDHLEFWEGVFTGLTHIDAHFLSQTKQSGENFPYLVAYQATVCARAQAPPPSWDQMWKCLTRLKPTLHGPTPLLYRLGAVQNEVTLTHPITKYIMTCMSADLEVVTSTWVLVGGVLAALASYCLSTGCVVIVGRIVLSGKPAIIPDREVLYREFDEMEECSQHLPYIEQGMMLAEQFKQKALGLLQTASRQAEVVAPAVQTNWQKLEAFWAKHMWNFISGIQYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTTILSSLTVTQLLRRLHQWISSECTTPCSGSWLRDIWDWICEVLSDFKTWLKAKLMPQLPGIPFVSCQRGYKGVWRGDGIMHTRCHCGAEITGHVKNGTMRIVGPKTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSMASSSASQLSAPSLRATCTTNHDSPDAELIEANLLWRQEMGGNITRVESENKVVILDSFDPLVAEEDEREVSVPAEILRKSRKFTPALPIWARPDYNPPLVEPWKKPDYEPPVVHGCPLPPPQSPPVPPPRKKRTVILTESTLPTALAELATKSFGSSSTSGITGDDTTTSPEPASSSCPPDSDAESYSSMPPLEGEPGDPDLSDGSWSTVSSEADKEDVVCCSMSYTWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVFPDLGVRVCEKMALYDVVSKLPLAVMGSSYGFQYSPGQRVEFLVQAWKSKKTPMGFSYDTRCFDSTVTENDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARNVRARLLSRGGRAAICGKYLFNWAVRTKLKLTPIAAAGRLDLSGWFTAGYSGGGIFHSVSHARPRWFWFCLLLLAAGVGIYLLPNR

SEQ ID NO: 154 - protein, 3011 aa, Artificial Sequence
  plasmid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGCIITSLTGRDKNQVEGEIQIVSTAAQTFLATCINGVCWTVYHGAGTRTIASPKGPVIQMYTNVDKDLVGWPAPQGARSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVPQSFQVGHLHAPTGSGKSTKVPAAYAAQGYKVLVLNPSVAATLGFGAYMSKAHGVDPNIRTGVRTITTGSPITYSTYGKFLADGGCSGGAYDIIICDECHSTDATSILGIGTVLDQAETAGARLVVLATATPPGSITVPHPNIEEVALSTTGEIPFYGKAIPLEAIKGGRHLIFCHSKKKCDELAAKLVALGINAVAYYRGLDVSVIPTSGDVVVVATDALMTGYTGDFDSVIDCNTCVTQTVDLSLDPTFTIETTTLPQDAVSRTQRRGRTGRGKPGIYRFVALGERPSGMFDSSVLCECYDAGCAWYELTPAETTVRLRAYMNTPGLPVCQDHLEFWEGVFTGLTHIDAHFLSQTKQSGENFPYLVAYQATVCARAQAPPPSWDQMWKCLTRLKPTLHGPTPLLYRLGAVQNEVTLTHPITKYIMTCMSADLEVVTSTWVLVGGVLAALASYCLSTGCVVIVGRIVLSGKPAIIPDREVLYREFDEMEECSQHLPYIEQGMMLAEQFKQKALGLLQTASRQAEVVAPAVQTNWQKLEAFWAKHMWNFISGIHYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTTILSSLTVTQLLRRLHQWISSECTTPCSGSWLRDIWDWICEVLSDFKTWLKAKLMPQLPGIPFVSCQRGYKGVWRGDGIMHTRCHCGAEITGHVKNGTMRIVGPKTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSMASSSASQLSAPSLRATCTTNHDSPDAELIEANLLWRQEMGGNITRVESENKVVILDSFDPLVAEEDEREVSVPAEILRKSRKFTPALPIWARPDYNPPLVEPWKKPDYEPPVVHGCPLPPPQSPPVPPPRKKRTVILTESTLPTALAELATKSFGSSSTSGITGDDTTTSPEPASSSCPPDSDAESYSSMPPLEGEPGDPDLSDGSWSTVSSEADKEDVVCCSMSYTWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVFPDLGVRVCEKMALYDVVSKLPLAVMGSSYGFQYSPGQRVEFLVQAWKSKKTPMGFSYDTRCFDSTVTENDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARNVRARLLSRGGRAAICGKYLFNWAVRTKLKLTPIAAAGRLDLSGWFTAGYSGGGIFHSVSHARPRWFWSCLLLLAAGVGIYLLPNR

SEQ ID NO: 155 - protein, 3011 aa, Artificial Sequence
  plasmid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGCIITSLTGRDKNQVEGEIQIVSTAAQTFLATCINGVCWTVYHGAGTRTIASPKGPVIQMYTNVDKDLVGWPAPQGARSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVPQSFQVGHLHAPTGSGKSTKVPAAYAAQGYKVLVLNPSVAATLGFGAYMSKAHGVDPNIRTGVRTITTGSPITYSTYGKFLADGGCSGGAYDIIICDECHSTDATSILGIGTVLDQAETAGARLVVLATATPPGSITVPHPNIEEVALSTTGEIPFYGKAIPLEAIKGGRHLIFCHSKKKCDELAAKLVALGINAVAYYRGLDVSVIPTSGDVVVVATDALMTGYTGDFDSVIDCNTCVTQTVDLSLDPTFTIETTTLPQDAVSRTQRRGRTGRGKPGIYRFVALGERPSGMFDSSVLCECYDAGCAWYELTPAETTVRLRAYMNTPGLPVCQDHLEFWEGVFTGLTHIDAHFLSQTKQSGENFPYLVAYQATVCARAQAPPPSWDQMWKCLTRLKPTLHGPTPLLYRLGAVQNEVTLTHPITKYIMTCMSADLEVVTSTWVLVGGVLAALASYCLSTGCVVIVGRIVLSGKPAIIPDREVLYREFDEMEECSQHLPYIEQGMMLAEQFKQKALGLLQTASRQAEVVAPAVQTNWQKLEAFWAKHMWNFISGIQYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGSHVSPTHYVPESDAAARVTTILSSLTVTQLLRRLHQWISSECTTPCSGSWLRDIWDWICEVLSDFKTWLKAKLMPQLPGIPFVSCQRGYKGVWRGDGIMHTRCHCGAEITGHVKNGTMRIVGPKTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSMASSSASQLSAPSLRATCTTNHDSPDAELIEANLLWRQEMGGNITRVESENKVVILDSFDPLVAEEDEREVSVPAEILRKSRKFTPALPIWARPDYNPPLVEPWKKPDYEPPVVHGCPLPPPQSPPVPPPRKKRTVILTESTLPTALAELATKSFGSSSTSGITGDDTTTSPEPASSSCPPDSDAESYSSMPPLEGEPGDPDLSDGSWSTVSSEADKEDVVCCSMSYTWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVFPDLGVRVCEKMALYDVVSKLPLAVMGSSYGFQYSPGQRVEFLVQAWKSKKTPMGFSYDTRCFDSTVTENDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARNVRARLLSRGGRAAICGKYLFNWAVRTKLKLTPIAAAGRLDLSGWFTAGYSGGGIFHSVSHARPRWFWSCLLLLAAGVGIYLLPNR

SEQ ID NO: 156 - protein, 3011 aa, Artificial Sequence
  plasmid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGCIITSLTGRDKNQVEGEIQIVSTAAQTFLATCINGVCWTVYHGAGTRTIASPKGPVIQMYTNVDKDLVGWPAPQGARSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVPQSFQVGHLHAPTGSGKSTKVPAAYAAQGYKVLVLNPSVAATLGFGAYMSKAHGVDPNIRTGVRTITTGSPITYSTYGKFLADGGCSGGAYDIIICDECHSTDATSILGIGTVLDQAETAGARLVVLATATPPGSITVPHPNIEEVALSTTGEIPFYGKAIPLEAIKGGRHLIFCHSKKKCDELAAKLVALGINAVAYYRGLDVSVIPTSGDVVVVATDALMTGYTGDFDSVIDCNTCVTQTVDLSLDPTFTIETTTLPQDAVSRTQRRGRTGRGKPGIYRFVALGERPSGMFDSSVLCECYDAGCAWYELTPAETTVRLRAYMNTPGLPVCQDHLEFWEGVFTGLTHIDAHFLSQTKQSGENFPYLVAYQATVCARAQAPPPSWDQMWKCLTRLKPTLHGPTPLLYRLGAVQNEVTLTHPITKYIMTCMSADLEVVTSTWVLVGGVLAALASYCLSTGCVVIVGRIVLSGKPAIIPDREVLYREFDEMEECSQHLPYIEQGMMLAEQFKQKALGLLQTASRQAEVVAPAVQTNWQKLEAFWAKHMWNFISGIQYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGTHVSPTHYVPESDAAARVTTILSSLTVTQLLRRLHQWISSECTTPCSGSWLRDIWDWICEVLSDFKTWLKAKLMPQLPGIPFVSCQRGYKGVWRGDGIMHTRCHCGAEITGHVKNGTMRIVGPKTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSMASSSASQLSAPSLRATCTTNHDSPDAELIEANLLWRQEMGGNITRVESENKVVILDSFDPLVAEEDEREVSVPAEILRKSRKFTPALPIWARPDYNPPLVEPWKKPDYEPPVVHGCPLPPPQSPPVPPPRKKRTVILTESTLPTALAELATKSFGSSSTSGITGDDTTTSPEPASSSCPPDSDAESYSSMPPLEGEPGDPDLSDGSWSTVSSEADKEDVVCCSMSYTWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVFPDLGVRVCEKMALYDVVSKLPLAVMGSSYGFQYSPGQRVEFLVQAWKSKKTPMGFSYDTRCFDSTVTENDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARNVRARLLSRGGRAAICGKYLFNWAVRTKLKLTPIAAAGRLDLSGWFTAGYSGGGIFHSVSHARPRWFWSCLLLLAAGVGIYLLPNR

SEQ ID NO: 157 - protein, 3011 aa, Artificial Sequence
  plasmid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGCIITSLTGRDKNQVEGEIQIVSTAAQTFLATCINGVCWTVYHGAGTRTIASPKGPVIQMYTNVDKDLVGWPAPQGARSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVPQSFQVGHLHAPTGSGKSTKVPAAYAAQGYKVLVLNPSVAATLGFGAYMSKAHGVDPNIRTGVRTITTGSPITYSTYGKFLADGGCSGGAYDIIICDECHSTDATSILGIGTVLDQAETAGARLVVLATATPPGSITVPHPNIEEVALSTTGEIPFYGKAIPLEAIKGGRHLIFCHSKKKCDELAAKLVALGINAVAYYRGLDVSVIPTSGDVVVVATDALMTGYTGDFDSVIDCNTCVTQTVDLSLDPTFTIETTTLPQDAVSRTQRRGRTGRGKPGIYRFVALGERPSGMFDSSVLCECYDAGCAWYELTPAETTVRLRAYMNTPGLPVCQDHLEFWEGVFTGLTHIDAHFLSQTKQSGENFPYLVAYQATVCARAQAPPPSWDQMWKCLTRLKPTLHGPTPLLYRLGAVQNEVTLTHPITKYIMTCMSADLEVVTSTWVLVGGVLAALASYCLSTGCVVIVGRIVLSGKPAIIPDREVLYREFDEMEECSQHLPYIEQGMMLAEQFKQKALGLLQTASRQAEVVAPAVQTNWQKLEAFWAKHMWNFISGIHYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGSHVSPTHYVPESDAAARVTTILSSLTVTQLLRRLHQWISSECTTPCSGSWLRDIWDWICEVLSDFKTWLKAKLMPQLPGIPFVSCQRGYKGVWRGDGIMHTRCHCGAEITGHVKNGTMRIVGPKTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSMASSSASQLSAPSLRATCTTNHDSPDAELIEANLLWRQEMGGNITRVESENKVVILDSFDPLVAEEDEREVSVPAEILRKSRKFTPALPIWARPDYNPPLVEPWKKPDYEPPVVHGCPLPPPQSPPVPPPRKKRTVILTESTLPTALAELATKSFGSSSTSGITGDDTTTSPEPASSSCPPDSDAESYSSMPPLEGEPGDPDLSDGSWSTVSSEADKEDVVCCSMSYTWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVFPDLGVRVCEKMALYDVVSKLPLAVMGSSYGFQYSPGQRVEFLVQAWKSKKTPMGFSYDTRCFDSTVTENDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARNVRARLLSRGGRAAICGKYLFNWAVRTKLKLTPIAAAGRLDLSGWFTAGYSGGGIFHSVSHARPRWFWSCLLLLAAGVGIYLLPNR

SEQ ID NO: 158 - protein, 3011 aa, Artificial Sequence
  plasmid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGCIITSLTGRDKNQVEGEIQIVSTAAQTFLATCINGVCWTVYHGAGTRTIASPKGPVIQMYTNVDKDLVGWPAPQGARSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVPQSFQVGHLHAPTGSGKSTKVPAAYAAQGYKVLVLNPSVAATLGFGAYMSKAHGVDPNIRTGVRTITTGSPITYSTYGKFLADGGCSGGAYDIIICDECHSTDATSILGIGTVLDQAETAGARLVVLATATPPGSITVPHPNIEEVALSTTGEIPFYGKAIPLEAIKGGRHLIFCHSKKKCDELAAKLVALGINAVAYYRGLDVSVIPTSGDVVVVATDALMTGYTGDFDSVIDCNTCVTQTVDLSLDPTFTIETTTLPQDAVSRTQRRGRTGRGKPGIYRFVALGERPSGMFDSSVLCECYDAGCAWYELTPAETTVRLRAYMNTPGLPVCQDHLEFWEGVFTGLTHIDAHFLSQTKQSGENFPYLVAYQATVCARAQAPPPSWDQMWKCLTRLKPTLHGPTPLLYRLGAVQNEVTLTHPITKYIMTCMSADLEVVTSTWVLVGGVLAALASYCLSTGCVVIVGRIVLSGKPAIIPDREVLYREFDEMEECSQHLPYIEQGMMLAEQFKQKALGLLQTASRQAEVVAPAVQTNWQKLEAFWAKHMWNFISGIHYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGTHVSPTHYVPESDAAARVTTILSSLTVTQLLRRLHQWISSECTTPCSGSWLRDIWDWICEVLSDFKTWLKAKLMPQLPGIPFVSCQRGYKGVWRGDGIMHTRCHCGAEITGHVKNGTMRIVGPKTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSMASSSASQLSAPSLRATCTTNHDSPDAELIEANLLWRQEMGGNITRVESENKVVILDSFDPLVAEEDEREVSVPAEILRKSRKFTPALPIWARPDYNPPLVEPWKKPDYEPPVVHGCPLPPPQSPPVPPPRKKRTVILTESTLPTALAELATKSFGSSSTSGITGDDTTTSPEPASSSCPPDSDAESYSSMPPLEGEPGDPDLSDGSWSTVSSEADKEDVVCCSMSYTWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVFPDLGVRVCEKMALYDVVSKLPLAVMGSSYGFQYSPGQRVEFLVQAWKSKKTPMGFSYDTRCFDSTVTENDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARNVRARLLSRGGRAAICGKYLFNWAVRTKLKLTPIAAAGRLDLSGWFTAGYSGGGIFHSVSHARPRWFWSCLLLLAAGVGIYLLPNR

The invention claimed is:

1. An isolated nucleic acid molecule, which encodes a human hepatitis C virus, wherein said molecule:
   (i) is capable of expressing said virus when transfected into cells,
   (ii) is capable of infectivity in vivo,
   (iii) comprises at least one adaptive mutation in the amino acid sequence of NS3, which is F1464L,
   (iv) comprises at least one adaptive mutation in the amino acid sequence of NS4A, which is A1672S, and
   (v) comprises at least one adaptive mutation in the amino acid sequence of NS5B, which is D2979G,
   wherein the amino acid positions of the adaptive mutations are given with reference to the sequence provided at GenBank accession number AF009606.

2. The isolated nucleic acid molecule according to claim 1, further comprising a shortened 3' UTR region.

3. The isolated nucleic acid molecule according to claim 1, wherein the human hepatitis C virus is of a genotype selected from the group consisting of 1a, 1b, 2a, 2b, 2c, 3a, 4a, 4d, 5a, 6a and 7a.

4. The isolated nucleic acid molecule according to claim 1, wherein the human hepatitis C virus is a strain of genotype 2a.

5. The isolated nucleic acid molecule according to claim 1, wherein the hepatitis C virus is of genotype 2a and is isolate J6_LSGΔ33U (SEQ ID NO:25).

6. The isolated nucleic acid molecule according to claim 4, wherein said nucleic acid molecule comprises at least one further adaptive mutation selected from the group consisting of F772S in p7, P1096L in NS3, N1927S in NS4B, N1927T in NS4B and Y2981F in NS5B.

7. The isolated nucleic acid molecule according to claim 4, wherein the hepatitis C virus is of genotype 2a and is isolate J6cc (SEQ ID NO:39).

8. The isolated nucleic acid molecule according to claim 1, wherein the human hepatitis C virus is a strain of genotype 2b.

9. The isolated nucleic acid molecule according to claim 1, wherein the hepatitis C virus is of genotype 2b and is isolate J8_LSG (SEQ ID NO:41).

10. The isolated nucleic acid molecule according to claim 8, wherein said nucleic acid molecule comprises at least one further adaptive mutation in the nucleic acid sequence selected from the group consisting of F768C in p7, W860R in NS2, A1204T in NS3, I1964V in NS4B, E2263V in NS5A, and H2900R in NS5B.

11. The isolated nucleic acid molecule according to claim 8, wherein the hepatitis C virus genotype 2b is isolate J8cc (SEQ ID NO:56).

12. The isolated nucleic acid molecule according to claim 1, wherein the human hepatitis C virus is a strain of genotype 1a.

13. The isolated nucleic acid molecule according to claim 12, wherein said nucleic acid molecule comprises at least one further adaptive mutation selected from the group consisting of A1226G, Q1773H, N1927S, N1927T and F2994S.

14. The isolated nucleic acid molecule according to claim 12, wherein the hepatitis C virus is of genotype 1a and is isolate TNcc (SEQ ID NO:145).

15. A cassette vector for cloning viral genomes, comprising, inserted therein, the nucleic acid sequence according to claim 1 and having an active promoter upstream thereof.

16. A method for producing a cell, which replicates human hepatitis C virus and produces a virus particle comprising introducing the nucleic acid molecule of claim 1 into a cell.

17. An isolated cell comprising the nucleic acid molecule of claim 1.

18. A method for producing a hepatitis C virus particle, comprising culturing a cell that comprises the isolated nucleic acid molecule of claim 1 under conditions that allow the cell to produce a hepatitis C virus particle.

19. A method for producing a hepatitis C virus-infected cell in vitro comprising culturing a cell that comprises the isolated nucleic acid molecule of claim 1 under conditions that allow the cell to produce a hepatitis C virus particle and infecting other cells with the virus particle that is produced in the culture.

20. A method for screening an anti-hepatitis C virus substance, comprising:
   a) culturing an isolated nucleic acid of claim 1, a cell comprising the isolated nucleic acid of claim 1, or a hepatitis C virus particle obtained by the method of claim 18 with a hepatitis C virus permissive cell, and
   b) detecting replicating hepatitis C virus RNA or hepatitis C virus particles in the resulting culture.

* * * * *